United States Patent 9,782,462 (MODIFIED POLYNUCLEOTIDES FOR THE PRODUCTION OF PROTEINS ASSOCIATED WITH HUMAN DISEASE) - sequence listing, part 9

SEQ ID NO: 9000 - DNA, 7730 bp, Homo sapiens
gcttccgtagaggccagctggttgctacgcagcaacaggaaacattccgcgctaccgagtactttctactcccgaccaggcattgctctctctggagaccctcggcggtggttgctgtattttgacttggagtaaggatgacttttcgggccacagatagtgaatttgacctgacaaatattgaagagtatgccgaaaattctgcactttcaagactgaataatataaaagccaaacaaagagtgagttatgtgacatccacagaaaatgaatctgatacacaaatcctaacgtttaggcacattacaaaagctcaggagaagacaagaaaacgacagcagcctataaaactagagcctttgccagtgctaaaagtctaccaagatcataagcagccagaatacatacatgaacagaaccgatttcagttaatgactgcaggaatcattaaacgtccagtaagcatagcaaaaaaaagttttgccacatcatctactcagtttcttgagcatcaagatgctgtgaaaaaaatgcagattcatcggccctatgttgaggtgttctctccctctcctcctaaactgccacatactggtattggaaaaagaggtctctttgggactagatcttcagcttaccctaagtacacttttcacgaccgagaagaagttgttaaagccaacattcgtgatcccttgcaaatcattaaaataatacgtgaaaatgaacatcttggatttctttatatgatccctgcagtgccaagatcatccattgaatatgatacatataatctaaaagttgtaagttatgagaacatcaataaaaatgactactatactattagccaaagggcagtaacacacatttataatgaagacattgaatttatcgaaattgatcgatgggaacaggaatatctgtatcacagagaactcactaagattcccatattttcactgttccggaaatggaaggcttttagtgtatggaggaagaatgtccgctccaagaaaatcactggatgtcaaaaatctctacaaaaaaatttgttcattgttaatcctcatttgcgaccagctcttcttaaaataaatgaattgtgttatcatttgagttttatgggactttgttatattgaaaagtgtcacacctacaccctgcaggaatttaaggccgcacaagtcatacggctagcagaggtgacagaacgcctaggagaatttcgaaatgaggcaaaatatgtagtcaggagggcttgtcgatttgctttgcgtgctgcaggatttgttcctgatgactgtgcatttggaccttttgaggattatcataaagtgcagagcagtggaagtttcattaatacaccacatgagttgcccacttatggagactctgagaaaatgacatatacagaacaggccagcaaaaggcattattgcatgaggctgacgtgctttattcgtctaaacgactatctaattgagaacacaatgcacatcttaacggtaaatgctgttaattcgcttttgaaccatctcactgacaagctaaaacgaacaccttcagcagatgtcattcagaaatggattactgaagagaagcctgaagtccctgataaaaaggggacccttatggtggaaaagcaagaagaagatgaatctctcatccccatgtttctcacagaactaatgttgacagtccagtcactgctctttgagccttctctggaagactttctggatggtattttgggtgcagttaatcactgtcaaaacactgtgttatcagttcctaatctcgtgcctgattcgtattttgatgctttcaccagcccttatattaacaacaaacttgaaggaaaaacctgtggaactgggccaagtttagcagcagtatttgaggatgataagaattttcacacaattatttctcaaataaaggaaaccattcaggccgcatttgaatcagcccgcatctatgcagctacctttgaaaagttccagatattcttcaaggaaaatgaaagtcttgatttacaagctcttaaacttcaggaacctgatattaacttttttagtgaacaactggaaaaatatcacaaacagcacaaggacgcagtagcgctcagacccaccagaaatgtaggattgctgctcattgatactaggcttctaagagaaaaattaattccatcacctttgcgatgcttagaggtgctaaattttatgcttcctcgtcaaagcaagaaaaaagtggatgccattatctttgaggcacaagatgcagagtataaacttgagtttgttccaactactaccacagaatatgttcatagcttattatttcttgatgaaattcaggaacggattgaaagccttgaagatgaggggaatatagtgactcaaatgtacaagcttatggaacaatatcaggtgcccacacctcctgaagactttgctgtttttgcaactatgaagccatccattgttgctgttcggaatgccattgataaatcagtgggtgatagagaatcaagcattaagcaattttgtgtgcatttgggtagtgatcttgaagaattaaacaacgaagtgaatgaagtaaaactgcaagcacaggatccacagattttagatatctctgctgaccaagacaaaataaggctcatattgaataatctgcaatctgttctggctgatcttcagaaacgtgcatttcagtataagtcctatcagaagaattttaaggtagaagtgtccaagtttgaagctttggaagaagtcagtgctgaactgaagctcaaacaattgctctgggattctttctctgaatgggataaactccaacaagaatggttaaagtccaaatttgattgcctggatccagaagtcctaaacggtcaagtttctaaatatgctaaatttgtgactcaactggaaaaaggcttgccacccaacagtgtagtgccccagctcaaatacaaggtggaaaaaatgaaagaaaagcttccagttatcattgacttgaggaacccgactttgaaggcaagacattgggcagctattgaacaaacagttgatgccactctagtggatgctgaaattccattaaccttggagaggctctcccagttgcatgtttttgactttggtcaagaaatccaggacatatctggacaggcttctggagaagctgccttagaagcaattcttaaaaaggtggaggactcttggaaaacaactgaatttgtcattctgcctcaccgtgactccaaagatgtgtttatactgggcggcacagatgacatacaggtccttcttgatgatagcaccatcaatgttgcaactcttgcctcatcacgttaccttggtccactgaaaactcgagtggatgaatggcaaaaacaacttgctttatttaatcaaacactggaagagtggctgacctgccagagaaactggctctacctagaaagtattttcaatgctccagacattcagaggcaattgcctgcagaggccaagatgttccttcaggtggataagtcatggaaagaaatcatgagaaaggtgaatcggctgcctaatgctcttcgagccgctactcagccaggacttctggaaacttttcaaaacaataatgcattacttgaccaaattcagaagtgcctagaggcatacttagaatcaaaaagagttatctttccaaggttttacttcttgtcaaatgatgaacttctggagattttggcccagacacgaaatccacaggccgtgcagccacacttaaggaaatgcttcgactccatttcaaagctcgaatttgctctcatgcctcctgccgaaggaaagattcctggtattgatggagaaccagaaaaggtttatactaatgatattttagcaatgctgtcaccagagggagaaagggttagcttggggaaaggcctcaaggcccgaggcaatgtagaggaatggcttggtaaagtggaagaagccatgttcacatctctgcgtcgcctgtgcaaagctgccatcgctgactatcaggggaaactgaggacagactgggtggttgctggccacccttctcaagttatcctgactgtttctcaaattatgtggtgccgtgatttgactgaatgtctggaaacagaacacagtaatcatatacaggccctgaagaattttgaaaaagtaaattttgagagattaaatgccctagctgcaatagttcaaggcagtcttcctaaattacacagaaacatcctaactgcattgattactattgatgtgcatgcaagagatatagtcactgaacttgttcaatccaaggtggagacagttgaatcttttgactggcagagacaactgcgctattactgggatatagacctggataattgtgtggctagaatggcgctctctcagtacacttatggctatgaatatttgggtgcatgcccaagattggttattactccactcacagatcgctgctatctttgcctcatgggagctttgcagcttgaccttgggggtgcaccagctggtcctgctggcactgggaaaacagagactaccaaagatctggcaaaagctcttgccatccagtgtgtggtctttaactgttcagatggtttggactacaagatgatggggcgcttcttcagtggcttggcacagtcaggggcctggtgctgctttgatgaatttaatcgaattgacatagaagttctgtccgtcatcgcgcagcaactcattaccattaggaacgccaaagcggcaaagctctctagattcatgtttgaggggcgggaaataaagttggtgatgacttgtgcagccttcatcacaatgaatcctggctatgcagggagaactgaattgccagataatttgaaagccctgtttagaccatttgcgatgatggttccaaattatgccttgattgcagaggtaattctatattctgaaggatttgaatccagtaaaatattagcaagaaaaatgactcagatgtataagctttgcagtgagcagctgtctcagcaggatcactacgactttggcatgagagctgtgaagtctgtcctggtcatggctggatctttaaaaagagaaaacccagacctaaatgaagatgtggtgttgataagagctttacaagactccaatttgccaaaatttctaacagatgatgctcttctgttcagtggaatcatatctgacctttttcctggagtccaaattccagaacatgattatggtattttacaatcaacaattgtggatgtcatgaatagacaaaatcttcagcctgagatgtgtatggttagaaaggtgatacagttttatgaaactatgctagtaaggcatggtgttatgttagtcgggccaacaggaggcggcaagaccacagtttaccgaatactagcagaaactttagggaatttacaaaaacttgggatagaaaattccttttaccaagcagttaaaacatatgttctcaaccctaaatcaattaccatgggtgaattatatggagaggttaataacttaaccttggaatggaaagatggtttgatggcactaagtgtccgagcagctgtgaatgatacttcagaagaccataaatggatcatcagtgatgggccagtagatgctctttggattgaaaacatgaatacagtgctggatgataacaagatgctttgcctggctaacagtgagaggattaaactcacacctcaaattcacatgctttttgaggtgcaagatctgcgggttgcctcccctgcaacagtcagtcgatgtggaatggtgtttgtggatcctgaagaactgaaatggatgccttatgttaaaacttggatgaagggtatttctaaaaaactgactgaggaaacccaagaatatatattgaatcttttccaacgttatgttgatgaaggtttacattttatcaataaaaagtgcagccaagcaattccacaagtggacatcagcaaagttactacactctgttgcttattggagtccttgatacttgggaaagatggagttaacttggcaatggaacaaacaaaattgaacactatactatgtcagacttttgtattctgttatttgtggtctttgggtggaaacctaactgaaaactactatgattcttttgatacatttattagaacacaatttgatgataatcctgatgccaggcttcccaattctggtgatctgtggagcattcatatggactttgacaccaaacggctggatccctgggaacgaatcatacctactttcaaatacaaccgagatgttccattttttgaaatgcttgtccccacaactgacacagtgcgctatgggtatctaatggaaaaactactggcagtcaagcattccgtgttgtttactggaataactggagtgggcaagtctgtgattgcaaaaggattgctaaataaaattcaagaatcagctggctatgtccctgtttatctaaatttttctgctcaaacttcatctgcaaggacacaagagatcattgagtcaaaactggagagaaaaagaaaaaatattctaggagcaccgggaaacaaacgaattgtgatttttgttgatgatttaaacatgcccagactggatcgctatggctctcagcctccgattgaattacttcggcagtatcaagattttgggggattttatgacagaaacaaactgttttggaaagaaatacaggatgtaacaatcatatcggcatgtgcacctccaggcggtggccgcaaccctgtgactccccgcttcatcagacacttcagcatgctgtgcctcccaatgccctcagagcacagtctgaaacagatttttcaggccatcttaaatggtttcctgagtgactttccaccagctgtaaagcaaactgcatcaagcattgtagaagcctcagttgagatttataacaaaatgagtgttgacctcctgccaacacccgccaagtcccattatgtctttaacttgagggacttatccaaatgtgtgcaagacaaacattttggaattgcaattgacctggaatattttttgaataagcccatcatatttggagatttcattaagtttggagcagataaagctgatcggatttatgatgacatgcctgatatagagaaaactgcaaatgttctacaggactatcttgatgattataatctcacaaatcccaaagaagtaaagttggtgttcttccaggatgctatagaacatgtttcaaggattgctcggatgatacgtcaagaaagaggcaatgccctgcttgttggagtaggaggcacaggaaagcagtcactcacgagacttgcagctcatatatgcggttacaaatgtttgcagattgaactcagccggggatataattatgatagttttcatgaagacctgaggaagttgtacaaaatggctggtgtagaagacaagaatatggttttccttttcactgacacccagattgtagtggaggagttcctagaagatataaataacatcctgaactcaggtgaagtgcctaatttatttgaaaaggatgaactggagcaggttttagcggccaccagaccaagagcaaaagaagtaggaatttctgaggggaacagagacgaggtaggatgtgccagagtagttatgtggctttatcacaaaaacgtttcttcaccttttatttaa

SEQ ID NO: 9001 - DNA, 14215 bp, Homo sapiens
ggagcagaggctcctccctctacggaagaggctgcccctccccgttcagaagaggaagaggccccgcgccctccgacagtggaggccccggcagaagatggtttctctccttccgcagaagatgctgtttcttctgtggtggattatcgggatctcattccttctgaagaagggatagttcttccagatgatcatgaagcggatctgaatagagttcgacagaggcttgcaccgcgaccggttcagtcagtgatttcggaagtgctgtccttgccgtcttcccggaggtcctccagataccgccggagtatgagtggccttcccaatctacaggaaacattaaaagagagacaggcaagatttagagaggcaagggaaagccgaagactgaaaattgacccttcatacaaatatatatttgaaattctagcagaaaatcttggcctggacatagtaactgttgaagaattaattttggattgcccatctctggaagcatttactaatttttttgcgaaagatggttgtaagacactgaaatttttgtaccaagaaggagatgtacctggtattgaatgtggtcgaactattgctggagcaactaaaggggcaaaaatgatgaaattgtatatagacaatgcagccccggataaactaaaaggactgtgcatattttttgttcgttgccgtaatgatgttgctataaatgttaaaactattcaagaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaagaattggcgtgatttggatgcaagaatcactgatacagcaaatgaatccaaagataatgtcagatatttgtatactttggaaaaagtgtgtcaacctctctataaccatgacctagtttccatggcacatggaatacaaaatttgattaatgccatcagaatgattcacggtgtgtcaaggtattataatacctcagagagaatgacctcattgtttatcaaggtaacaaatcaaatggtaacagcatgtaaagcatatattactgatggaggattaaaccatgtatgggatcaggaaacgccagttgtactaaagaaaattcaggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtacaaatacaggcatttatgaacagtagttttgggaaaatcttatcttctcagcaggctcttcagctacttcaaaggtttcagaagctgaacattccctgtctgggattagaaataaaccacacaatagagcgtattcttcagtactatgtggctgaacttgatgctactaagaagctttatcattctcagaaagatgacccccctcttgctcgcaacatgccccctatagcaggaaaaatactctgggtgaggcagctctatcgccggataagtgagcccatcaattatttctttaaaaactcagacattttatcaagtccggacggtaaagctgtcatccgtcagtataacaagatctcctatgtgctggtggaattcgaggtggtctatcacacagcctggatcagagagatttcacagttgcattacgctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcagggtcttctgcaatattatgatgagttatgtcaggaagtgccttctgtgtttgtcaatctgatgaccccaaaaatgaaaaaggtggaatctgtgttgaggcaaggactcacagtgttaacatggtcgtctttaacactggaaagcttctttcaagaagtcgaattagttttggatatgttcaatcaacttttaaagaagatcagtgacttgtgtgaaatgcatattgatacagttctgaaggagatagccaaaactgtgttgatttctctgcctgaaagtggtgctaccaaagtagaagatatgttgaccctcaatgagacatacacaaaagaatgggctgacattctaaaccacaaaagtaagcatgtggaagaagctgtcagagaacttatatcaatatttgagcagatttatgaagtgaaatacactgggaaagtaggaaaacagtcagaacagcggaaacacgttgtttttggaagtgaaacaggagagggtgaaaacaatgactatgaagctaatattgtgaatgagtttgatactcatgataaagaagatgaatttaaaaaggagtgtaaagaggtctttgcttttttctctcatcaattactagacagtcttcaaaaagctacacggttatctctggacacaatgaaaagaagaatatttgttgcaagcctttatgggcgaaagcagtcagaagatattatttcctttataaaaagtgaagtacatcttgcaattcctaatgtggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggaatttttggctaacaacccctctctgactgaaatcagatcagaaattctacactatgctacttttgaacaggagattgatgagttgaagcctattattgttgtaggagcacttgaattacatacagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagaagcctatgctattttaaacagatttgaagttgaagtaaccaaagaagaatcagaagcagttgataccttaagatattctttcaacaaattgcagagcaaagctgtttcagtacaagaggacctagttcaagtgcagccaaagtttaaaagcaatctacttgagtctgtggaagtttttcgtgaggacgtgataaactttgcagaagcatatgaattggaaggacctatggttccaaatataccaccccaagaagctagcaacaggctacagatatttcaggccagtttcgatgatctgtggaggaaatttgttacgtattcatctggtgaacaactttttggattgcctgtgactgattatgaggttttacacaaaaccagaaaagaactcaacttgctgcagaagctgtatggattgtatgacaccgtaatgagcagtattagtggttattatgaaatactttggggagatgtagatattgaaaaaattaatgcagaactgctggaatttcaaaacagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtatttggagaagaaacgattactgtttccaagattcttctttgtatctgatccagttctcctggaaattcttggacaagccagtgattcccacaccatacagccgcatctccctgcagtatctgacaacatcaatgaggtgacatttcatgcaaaagactatgatcgcatcatggccgtcatatcaagagaaggagaaaaaattgttttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagatagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacagatcattatgagagttaaacttgcaagctgtggttttcttgaaaatgttatcttggctcaaaaattttacgttctttacaaactctgtgaagagcaacttactaaacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggcatggttgaagaaacgcactgcacaggaagctgctgtattcctgacactgtatgagaaagtctttgaagatacatacacatatatgaagctaaatctcaatcccaaaatgcagctcttggagtgcaactatattgtgcaatctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtgattgggagcactggaataagaaacttcagccttattattatccaactgacagtattccggaatattcatcaattttggttccaaatgttgacaatattagaacaaattttttgatagacaccattgcaaaacaacataaagctgttttgctcacaggagagcagggaactgcaaaaactgtcatggttaaggcctatttgaaaaaatatgatcctgaagtacagctatccaaaagtctaaacttttcatctgccacagaaccaatgatgtttcagagaacaattgaaagctacgtggataagcgaattggaagcacatatgggccaccaggagggagaaaaatgactgtatttattgatgatattaatatgcctgtgattaatgagtggggagatcagataactaatgagattgtgcgacagatgatggaaatggaaggaatgtacagcttggacaagcctggagacttcactactattgttgatgtgcagctcatagcagcaatgatccaccctggaggtggtcgaaatgatattccacaacgtttaaaaagacaatttactgtgtttaattgtacattgccttcaaatgcttcaatagacaaaatttttggaattattggatgtggatactttgatccttgtagaagtttcaagcctcaaatatgtgagatgattgtgaatttagtctcagtgggtagagtgctgtggcaatggactaaggtgaagatgctgccaactccttctaaatttcattacatcttcaatcttcgagatctttccagaatttggcaaggaatgttgaccataaaagctgaggagtgcgcttcaatccctactctcctgtcccttttcaaacacgagtgcagcagagtaattgcagacagatttataactcctgaagatgagcagtggtttaatgcacatcttactcgtgcagttgaagaaaatattggctctgatgcagcgtcgtgtattcttcctgaaccatactttgtggattttcttcgtgagatgccagaaccaactggtgatgaacctgaagactctgtgtttgaagtacccaaaatatatgaattgatgccatcctttgactttctggctgaaaaactccagttttaccagagacagttcaatgaaatcattagaggaacatctcttgatctggtgttttttaaagatgcaatgactcatcttattaagatttcacgaataattcgaacgtcgtgtggaaatgcattgctggtgggtgttggtggttccggaaaacaaagtctttcaagattggcctcttttattgctggctatcaaatattccagataacattaaccaggtcttacaatgtgactaatctaacagatgatttaaaagctttgtacaaagttgctggtgctgatggaaaaggcatcactttcatctttactgacagtgaaataaaagatgaggcatttctagaataccttaacaacttgctatcttcaggggagatctccaacttgtttgcacgagatgagatggatgaaatcacccaaggtctgatttcagtgatgaagagggagctacctcgccatcctcctacctttgataatttgtatgaatacttcatttcaagatcaaggaagaacttacatgttgttctctgcttttctccagttggtgagaagttccgtgcccgttctttgaaatttcctggcttgatatcaggttgcactatggactggttcagccgctggccaagggaggctctgattgctgtggcctcctacttcctttcagactataatattgtctgctctagtgaaattaaaagacaagttgtagaaacaatgggcctgtttcatgacatggtttcagagagctgtgaaagttatttccaaagataccgccgaagagcacatgtgactcccaaatcttacctctcatttataaatggttataaaaacatttatgctgaaaaggtgaagttcattaatgaacaggctgaacgtatgaatattggtcttgataaactaatggaggcaagtgaatctgttgctaaactctctcaggatcttgcagtcaaggagaaggagttggcagtggcttccataaaagcagacgaagtattagcagaagtcacagtaagcgctcaggcttcagccaaaattaaaaatgaagtacaggaggtaaaggacaaagcccaaaaaattgtggatgaaattgatagtgaaaaagtgaaagctgaaagcaagcttgaggcagctaaacctgcactggaagaagcagaagcagccctgaatactatcaagccaaatgatattgccacagtcaggaaacttgcaaaaccaccacatcttattatgagaatcatggactgtgttctgttactatttcaaaagaaaattgaccctgttactatggatccagaaaaatcttgctgtaagccatcatggggagagtcattaaagttgatgagtgcaacaggattcctgtggagccttcagcagttccctaaggacactataaatgaagagactgttgagttactacagccatattttaatatggatgattatacttttgaaagtgccaaaaaagtctgtgggaatgtggctggtctcctgtcttggacacttgctatggcaatattttatggcatcaatagagaagtgttgcctctgaaggccaacctggccaagcaggaaggccggttagcagttgctaatgctgagttagggaaggcacaagccctgctggatgagaagcaagctgagctggataaagtacaggcaaaatttgatgcagcaatgaatgagaaaatggatttgcttaatgacgctgatacgtgccggaaaaagatgcaggccgcctccactctcatcgatgggctgagtggagaaaaaatccggtggacccagcaaagtaaagaattcaaagctcagattaatagacttgtaggtgatattctgctgtgcacgggattcctttcctaccttggtcctttcaatcagatatttaggaactatttgcttaaagatcaatgggaaatggagttgagagcacggaaaattcctttcacagaaaacctgaatcttatttcaatgttggtggatcctccaactattggtgagtgggggctacagggattaccaggagatgatctctcaattcagaatggcattattgtgacaaaggccaccagatacccactcctcatagacccacaaactcaaggcaaaacttggattaaatcaaaggaaaaagaaaatgatttacaggtgacatctctgaaccataaatattttcgcacacacttggaggacagcctttccttgggccgaccccttctcattgaggacattcatgaagagctggatccagccttggataatgtattagaaaagaattttattaaatctggcaccactttcaaggtgaaagtcggtgataaggaatgtgatatcatggatacatttaaactttacattactacgaagttaccaaatcctgcctttaccccagagattaatgctaaaacgtcagtcattgatttcactgttacaatgaaaggacttgagaatcagttactaaggagagtcattctaacagagaaacaggagttagaggctgagagggttaaacttttggaggatgttacttttaataagcggaagatgaaagaacttgaagataacctcctctataaattaagtgctacaaaaggctcattggtagatgacgaatctctcattggtgtacttcgaactaccaagcagacagcagctgaggtaagtgaaaagttgcatgtggctgcagaaactgagatcaagatcaacgcggctcaggaggagttccggcccgcagccacccgcggaagcatcctctacttcctcatcacagagatgagcatggtcaacatcatgtatcagacgtcattggcccagttcttgaagttatttgaccagtccatggccagatctgaaaagtcaccactacctcaaaagagaattacaaatattatcgagtacctgacatatgaagtttttacatactctgtcagaggcctatacgaaaaccacaaattcctgtttgtactcctcatgaccttaaagattgaccttcagagagggacagttaagcacagagagtttcaagctctcattaaagggggagcagctctggacctgaaagcctgtcctcccaaaccctatcgctggatccttgacatgacttggctgaatcttgtggagctgagtaaacttccacaatttgcagaaattatgaaccagatatctcgtaatgagaaggggtggaaaagctggtttgataaagatgctccagaggaggaaattatccctgatggatataatgattcactagatacctgccataaacttttacttatcaggtcttggtgcccagaccgtactgtttttcaagcaagaaagtatattgcagattctttggaggagaagtacacagaaccagttatcttaaatctggagaaaacttgggaagaaagtgatacccggacacctctgatatgcttcctgtccatgggatctgaccccaccaatcaaattgatgcattggccaagaaactgaaactggaatgtagaactatctcaatggggcaaggacaagaagtacatgctcgaaagctgattcagatgtcaatgcagcagggtggttgggtattactacaaaattgccaccttggcctggaattcatggaagaattactagagacgctaattaccactgaagccagtgatgattctttccgagtatggataactacggagccccatgatcgatttccaattacattgcttcagacctctctcaaattcactaatgagccaccccaaggtgtacgcgcaggtttgaaaagaacatttgctggaattaatcaagaccttctggacatcagtaatttacccatgtggaagccgatgctttacacagtagcatttttacactccactgtgcaggagcgacgaaaatttggccccttaggatggaatattccctacgaattcaattctgctgacttttcagccagtgttcagtttattcagaatcaccttgatgaatgcgatattaagaaaggtgtatcatggaatacggttcggtacatgatcggagaagtacaatatggaggcagagtgacagatgactttgacaaacgtctacttaattgctttgccagagtctggttcagtgagaagatgtttgaaccgtcattctgcttttatactggatataaaatccccttatgcaaaaccttagaccagtattttgaatacatccagtcactgccatccctagataaccctgaagtctttgggcttcaccctaatgctgatatcacgtatcagagtaacactgcttctgctgttcttgaaacaattaccaacattcaacccaaagagagtggaggtggtgtgggagagacccgggaggctattgtttatagattatctgaagatatgctgagtaaactccctcctgattacattcctcatgaggtgaaatctcgtttgataaagatgggccatcttaattcaatgaacatatttcttagacaagaaattgacagaatgcaaagagtcatttcaatactccgcagtagcctgagtgatctaaaattggccattgaaggaacaatcattatgagtgagaatctgagagatgctctggacaacatgtatgatgctcgtatacctcagctctggaaaagagtgtcttgggattcgtccacactgggcttctggttcactgaacttttggaaagaaatgctcagttttctacgtggatatttgaagggaggcctaatgtgttttggatgactggtttctttaatccccaaggcttcctcacagcaatgaggcaagaagtgacccgtgcccacaaaggctgggcactggacactgtgaccatccacaatgaagttctgagacagaccaaggaggagatcacgtcaccccctggggaaggtgtgtatatttatgggctctacatggatggagcagcctgggacagacggaatgggaagctcatggaatccacccccaaggtactcttcacgcagttacccgtgctccacatctttgccattaactccacggcacccaaggaccccaagctgtatgtgtgtcctatttacaagaaacccaggcgaactgatttgaccttcatcactgtggtatatttacgaacagtgttgtccccggatcactggatcctgagaggagtggcccttttgtgtgacatcaagtaagttcatttccatctgctcagggcaccagaacccacatagacagcctgtgctattgagggactcagtgatgtgtgtgtcttttctccccagtaattccttaattactctttctacattaaaaagttga

SEQ ID NO: 9002 - DNA, 13860 bp, Homo sapiens
tcttcccggaggtcctccagataccgccggagtatgagtggccttcccaatctacaggaaacattaaaagagagacaggcaagatttagagaggcaagggaaagccgaagactgaaaattgacccttcatacaaatatatatttgaaattctagcagaaaatcttggcctggacatagtaactgttgaagaattaattttggattgcccatctaatgtggtcgaactattgctggagcaactaaaggggcaaaaatgatgaaattgtatatagacaatgcagccccggataaactaaaaggactgtgcatattttttgttcgttgccgtaatgatgttgctataaatgttaaaactattcaagaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaagaattggcgtgatttggatgcaagaatcactgatacagcaaatgaatccaaagataatgtcagatatttgtatactttggaaaaagtgtgtcaacctctctataaccatgacctagtttccatggcacatggaatacaaaatttgattaatgccatcagaatgattcacggtgtgtcaaggtattataatacctcagagagaatgacctcattgtttatcaaggtaacaaatcaaatggtaacagcatgtaaagcatatattactgatggaggattaaaccatgtatgggatcaggaaacgccagttgtactaaagaaaattcaggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtacaaatacaggcatttatgaacagtagttttgggaaaatcttatcttctcagcaggctcttcagctacttcaaaggtttcagaagctgaacattccctgtctgggattagaaataaaccacacaatagagcgtattcttcagtactatgtggctgaacttgatgctactaagaagctttatcattctcagaaagatgacccccctcttgctcgcaacatgccccctatagcaggaaaaatactctgggtgaggcagctctatcgccggataagtgagcccatcaattatttctttaaaaactcagacattttatcaagtccggacggtaaagctgtcatccgtcagtataacaagatctcctatgtgctggtggaattcgaggtggtctatcacacagcctggatcagagagatttcacagttgcattacgctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcagggtcttctgcaatattatgatgagttatgtcaggaagtgccttctgtgtttgtcaatctgatgaccccaaaaatgaaaaaggtggaatctgtgttgaggcaaggactcacagtgttaacatggtcgtctttaacactggaaagcttctttcaagaagtcgaattagttttggatatgttcaatcaacttttaaagaagatcagtgacttgtgtgaaatgcatattgatacagttctgaaggagatagccaaaactgtgttgatttctctgcctgaaagtggtgctaccaaagtagaagatatgttgaccctcaatgagacatacacaaaagaatgggctgacattctaaaccacaaaagtaagcatgtggaagaagctgtcagagaacttatatcaatatttgagcagatttatgaagtgaaatacactgggaaagtaggaaaacagtcagaacagcggaaacacgttgtttttggaagtgaaacaggagagggtgaaaacaatgactatgaagctaatattgtgaatgagtttgatactcatgataaagaagatgaatttaaaaaggagtgtaaagaggtctttgcttttttctctcatcaattactagacagtcttcaaaaagctacacggttatctctggacacaatgaaaagaagaatatttgttgcaagcctttatgggcgaaagcagtcagaagatattatttcctttataaaaagtgaagtacatcttgcaattcctaatgtggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggaatttttggctaacaacccctctctgactgaaatcagatcagaaattctacactatgctacttttgaacaggagattgatgagttgaagcctattattgttgtaggagcacttgaattacatacagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagaagcctatgctattttaaacagatttgaagttgaagtaaccaaagaagaatcagaagcagttgataccttaagatattctttcaacaaattgcagagcaaagctgtttcagtacaagaggacctagttcaagtgcagccaaagtttaaaagcaatctacttgagtctgtggaagtttttcgtgaggacgtgataaactttgcagaagcatatgaattggaaggacctatggttccaaatataccaccccaagaagctagcaacaggctacagatatttcaggccagtttcgatgatctgtggaggaaatttgttacgtattcatctggtgaacaactttttggattgcctgtgactgattatgaggttttacacaaaaccagaaaagaactcaacttgctgcagaagctgtatggattgtatgacaccgtaatgagcagtattagtggttattatgaaatactttggggagatgtagatattgaaaaaattaatgcagaactgctggaatttcaaaacagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtatttggagaagaaacgattactgtttccaagattcttctttgtatctgatccagttctcctggaaattcttggacaagccagtgattcccacaccatacagccgcatctccctgcagtatctgacaacatcaatgaggtgacatttcatgcaaaagactatgatcgcatcatggccgtcatatcaagagaaggagaaaaaattgttttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagatagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacagatcattatgagagttaaacttgcaagctgtggttttcttgaaaatgttatcttggctcaaaaattttacgttctttacaaactctgtgaagagcaacttactaaacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggcatggttgaagaaacgcactgcacaggaagctgctgtattcctgacactgtatgagaaagtctttgaagatacatacacatatatgaagctaaatctcaatcccaaaatgcagctcttggagtgcaactatattgtgcaatctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtgattgggagcactggaataagaaacttcagccttattattatccaactgacagtattccggaatattcatcaattttggttccaaatgttgacaatattagaacaaattttttgatagacaccattgcaaaacaacataaagctgttttgctcacaggagagcagggaactgcaaaaactgtcatggttaaggcctatttgaaaaaatatgatcctgaagtacagctatccaaaagtctaaacttttcatctgccacagaaccaatgatgtttcagagaacaattgaaagctacgtggataagcgaattggaagcacatatgggccaccaggagggagaaaaatgactgtatttattgatgatattaatatgcctgtgattaatgagtggggagatcagataactaatgagattgtgcgacagatgatggaaatggaaggaatgtacagcttggacaagcctggagacttcactactattgttgatgtgcagctcatagcagcaatgatccaccctggaggtggtcgaaatgatattccacaacgtttaaaaagacaatttactgtgtttaattgtacattgccttcaaatgcttcaatagacaaaatttttggaattattggatgtggatactttgatccttgtagaagtttcaagcctcaaatatgtgagatgattgtgaatttagtctcagtgggtagagtgctgtggcaatggactaaggtgaagatgctgccaactccttctaaatttcattacatcttcaatcttcgagatctttccagaatttggcaaggaatgttgaccataaaagctgaggagtgcgcttcaatccctactctcctgtcccttttcaaacacgagtgcagcagagtaattgcagacagatttataactcctgaagatgagcagtggtttaatgcacatcttactcgtgcagttgaagaaaatattggctctgatgcagcgtcgtgtattcttcctgaaccatactttgtggattttcttcgtgagatgccagaaccaactggtgatgaacctgaagactctgtgtttgaagtacccaaaatatatgaattgatgccatcctttgactttctggctgaaaaactccagttttaccagagacagttcaatgaaatcattagaggaacatctcttgatctggtgttttttaaagatgcaatgactcatcttattaagatttcacgaataattcgaacgtcgtgtggaaatgcattgctggtgggtgttggtggttccggaaaacaaagtctttcaagattggcctcttttattgctggctatcaaatattccagataacattaaccaggtcttacaatgtgactaatctaacagatgatttaaaagctttgtacaaagttgctggtgctgatggaaaaggcatcactttcatctttactgacagtgaaataaaagatgaggcatttctagaataccttaacaacttgctatcttcaggggagatctccaacttgtttgcacgagatgagatggatgaaatcacccaaggtctgatttcagtgatgaagagggagctacctcgccatcctcctacctttgataatttgtatgaatacttcatttcaagatcaaggaagaacttacatgttgttctctgcttttctccagttggtgagaagttccgtgcccgttctttgaaatttcctggcttgatatcaggttgcactatggactggttcagccgctggccaagggaggctctgattgctgtggcctcctacttcctttcagactataatattgtctgctctagtgaaattaaaagacaagttgtagaaacaatgggcctgtttcatgacatggtttcagagagctgtgaaagttatttccaaagataccgccgaagagcacatgtgactcccaaatcttacctctcatttataaatggttataaaaacatttatgctgaaaaggtgaagttcattaatgaacaggctgaacgtatgaatattggtcttgataaactaatggaggcaagtgaatctgttgctaaactctctcaggatcttgcagtcaaggagaaggagttggcagtggcttccataaaagcagacgaagtattagcagaagtcacagtaagcgctcaggcttcagccaaaattaaaaatgaagtacaggaggtaaaggacaaagcccaaaaaattgtggatgaaattgatagtgaaaaagtgaaagctgaaagcaagcttgaggcagctaaacctgcactggaagaagcagaagcagccctgaatactatcaagccaaatgatattgccacagtcaggaaacttgcaaaaccaccacatcttattatgagaatcatggactgtgttctgttactatttcaaaagaaaattgaccctgttactatggatccagaaaaatcttgctgtaagccatcatggggagagtcattaaagttgatgagtgcaacaggattcctgtggagccttcagcagttccctaaggacactataaatgaagagactgttgagttactacagccatattttaatatggatgattatacttttgaaagtgccaaaaaagtctgtgggaatgtggctggtctcctgtcttggacacttgctatggcaatattttatggcatcaatagagaagtgttgcctctgaaggccaacctggccaagcaggaaggccggttagcagttgctaatgctgagttagggaaggcacaagccctgctggatgagaagcaagctgagctggataaagtacaggcaaaatttgatgcagcaatgaatgagaaaatggatttgcttaatgacgctgatacgtgccggaaaaagatgcaggccgcctccactctcatcgatgggctgagtggagaaaaaatccggtggacccagcaaagtaaagaattcaaagctcagattaatagacttgtaggtgatattctgctgtgcacgggattcctttcctaccttggtcctttcaatcagatatttaggaactatttgcttaaagatcaatgggaaatggagttgagagcacggaaaattcctttcacagaaaacctgaatcttatttcaatgttggtggatcctccaactattggtgagtgggggctacagggattaccaggagatgatctctcaattcagaatggcattattgtgacaaaggccaccagatacccactcctcatagacccacaaactcaaggcaaaacttggattaaatcaaaggaaaaagaaaatgatttacaggtgacatctctgaaccataaatattttcgcacacacttggaggacagcctttccttgggccgaccccttctcattgaggacattcatgaagagctggatccagccttggataatgtattagaaaagaattttattaaatctggcaccactttcaaggtgaaagtcggtgataaggaatgtgatatcatggatacatttaaactttacattactacgaagttaccaaatcctgcctttaccccagagattaatgctaaaacgtcagtcattgatttcactgttacaatgaaaggacttgagaatcagttactaaggagagtcattctaacagagaaacaggagttagaggctgagagggttaaacttttggaggatgttacttttaataagcggaagatgaaagaacttgaagataacctcctctataaattaagtgctacaaaaggctcattggtagatgacgaatctctcattggtgtacttcgaactaccaagcagacagcagctgaggtaagtgaaaagttgcatgtggctgcagaaactgagatcaagatcaacgcggctcaggaggagttccggcccgcagccacccgcggaagcatcctctacttcctcatcacagagatgagcatggtcaacatcatgtatcagacgtcattggcccagttcttgaagttatttgaccagtccatggccagatctgaaaagtcaccactacctcaaaagagaattacaaatattatcgagtacctgacatatgaagtttttacatactctgtcagaggcctatacgaaaaccacaaattcctgtttgtactcctcatgaccttaaagattgaccttcagagagggacagttaagcacagagagtttcaagctctcattaaagggggagcagctctggacctgaaagcctgtcctcccaaaccctatcgctggatccttgacatgacttggctgaatcttgtggagctgagtaaacttccacaatttgcagaaattatgaaccagatatctcgtaatgagaaggggtggaaaagctggtttgataaagatgctccagaggaggaaattatccctgatggatataatgattcactagatacctgccataaacttttacttatcaggtcttggtgcccagaccgtactgtttttcaagcaagaaagtatattgcagattctttggaggagaagtacacagaaccagttatcttaaatctggagaaaacttgggaagaaagtgatacccggacacctctgatatgcttcctgtccatgggatctgaccccaccaatcaaattgatgcattggccaagaaactgaaactggaatgtagaactatctcaatggggcaaggacaagaagtacatgctcgaaagctgattcagatgtcaatgcagcagggtggttgggtattactacaaaattgccaccttggcctggaattcatggaagaattactagagacgctaattaccactgaagccagtgatgattctttccgagtatggataactacggagccccatgatcgatttccaattacattgcttcagacctctctcaaattcactaatgagccaccccaaggtgtacgcgcaggtttgaaaagaacatttgctggaattaatcaagaccttctggacatcagtaatttacccatgtggaagccgatgctttacacagtagcatttttacactccactgtgcaggagcgacgaaaatttggccccttaggatggaatattccctacgaattcaattctgctgacttttcagccagtgttcagtttattcagaatcaccttgatgaatgcgatattaagaaaggtgtatcatggaatacggttcggtacatgatcggagaagtacaatatggaggcagagtgacagatgactttgacaaacgtctacttaattgctttgccagagtctggttcagtgagaagatgtttgaaccgtcattctgcttttatactggatataaaatccccttatgcaaaaccttagaccagtattttgaatacatccagtcactgccatccctagataaccctgaagtctttgggcttcaccctaatgctgatatcacgtatcagagtaacactgcttctgctgttcttgaaacaattaccaacattcaacccaaagagagtggaggtggtgtgggagagacccgggaggctattgtttatagattatctgaagatatgctgagtaaactccctcctgattacattcctcatgaggtgaaatctcgtttgataaagatgggccatcttaattcaatgaacatatttcttagacaagaaattgacagaatgcaaagagtcatttcaatactccgcagtagcctgagtgatctaaaattggccattgaaggaacaatcattatgagtgagaatctgagagatgctctggacaacatgtatgatgctcgtatacctcagctctggaaaagagtgtcttgggattcgtccacactgggcttctggttcactgaacttttggaaagaaatgctcagttttctacgtggatatttgaagggaggcctaatgtgttttggatgactggtttctttaatccccaaggcttcctcacagcaatgaggcaagaagtgacccgtgcccacaaaggctgggcactggacactgtgaccatccacaatgaagttctgagacagaccaaggaggagatcacgtcaccccctggggaaggtgtgtatatttatgggctctacatggatggagcagcctgggacagacggaatgggaagctcatggaatccacccccaaggtactcttcacgcagttacccgtgctccacatctttgccattaactccacggcacccaaggaccccaagctgtatgtgtgtcctatttacaagaaacccaggcgaactgatttgaccttcatcactgtggtatatttacgaacagtgttgtccccggatcactggatcctgagaggagtggcccttttgtgtgacatcaagtaagttcatttccatctgctcagggcaccagaacccacatagacagcctgtgctattgagggactcagtgatgtgtgtgtcttttctccccagtaattccttaattactctttctacattaaaaagttgatgttct

SEQ ID NO: 9003 - DNA, 13365 bp, Homo sapiens
atgatgaaattgtatatagacaatgcagccccggataaactaaaaggactgtgcatattttttgttcgttgccgtaatgatgttgctataaatgttaaaactattcaagaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaagaattggcgtgatttggatgcaagaatcactgatacagcaaatgaatccaaagataatgtcagatatttgtatactttggaaaaagtgtgtcaacctctctataaccatgacctagtttccatggcacatggaatacaaaatttgattaatgccatcagaatgattcacggtgtgtcaaggtattataatacctcagagagaatgacctcattgtttatcaaggtaacaaatcaaatggtaacagcatgtaaagcatatattactgatggaggattaaaccatgtatgggatcaggaaacgccagttgtactaaagaaaattcaggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtacaaatacaggcatttatgaacagtagttttgggaaaatcttatcttctcagcaggctcttcagctacttcaaaggtttcagaagctgaacattccctgtctgggattagaaataaaccacacaatagagcgtattcttcagtactatgtggctgaacttgatgctactaagaagctttatcattctcagaaagatgacccccctcttgctcgcaacatgccccctatagcaggaaaaatactctgggtgaggcagctctatcgccggataagtgagcccatcaattatttctttaaaaactcagacattttatcaagtccggacggtaaagctgtcatccgtcagtataacaagatctcctatgtgctggtggaattcgaggtggtctatcacacagcctggatcagagagatttcacagttgcattacgctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcagggtcttctgcaatattatgatgagttatgtcaggaagtgccttctgtgtttgtcaatctgatgaccccaaaaatgaaaaaggtggaatctgtgttgaggcaaggactcacagtgttaacatggtcgtctttaacactggaaagcttctttcaagaagtcgaattagttttggatatgttcaatcaacttttaaagaagatcagtgacttgtgtgaaatgcatattgatacagttctgaaggagatagccaaaactgtgttgatttctctgcctgaaagtggtgctaccaaagtagaagatatgttgaccctcaatgagacatacacaaaagaatgggctgacattctaaaccacaaaagtaagcatgtggaagaagctgtcagagaacttatatcaatatttgagcagatttatgaagtgaaatacactgggaaagtaggaaaacagtcagaacagcggaaacacgttgtttttggaagtgaaacaggagagggtgaaaacaatgactatgaagctaatattgtgaatgagtttgatactcatgataaagaagatgaatttaaaaaggagtgtaaagaggtctttgcttttttctctcatcaattactagacagtcttcaaaaagctacacggttatctctggacacaatgaaaagaagaatatttgttgcaagcctttatgggcgaaagcagtcagaagatattatttcctttataaaaagtgaagtacatcttgcaattcctaatgtggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggaatttttggctaacaacccctctctgactgaaatcagatcagaaattctacactatgctacttttgaacaggagattgatgagttgaagcctattattgttgtaggagcacttgaattacatacagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagaagcctatgctattttaaacagatttgaagttgaagtaaccaaagaagaatcagaagcagttgataccttaagatattctttcaacaaattgcagagcaaagctgtttcagtacaagaggacctagttcaagtgcagccaaagtttaaaagcaatctacttgagtctgtggaagtttttcgtgaggacgtgataaactttgcagaagcatatgaattggaaggacctatggttccaaatataccaccccaagaagctagcaacaggctacagatatttcaggccagtttcgatgatctgtggaggaaatttgttacgtattcatctggtgaacaactttttggattgcctgtgactgattatgaggttttacacaaaaccagaaaagaactcaacttgctgcagaagctgtatggattgtatgacaccgtaatgagcagtattagtggttattatgaaatactttggggagatgtagatattgaaaaaattaatgcagaactgctggaatttcaaaacagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtatttggagaagaaacgattactgtttccaagattcttctttgtatctgatccagttctcctggaaattcttggacaagccagtgattcccacaccatacagccgcatctccctgcagtatctgacaacatcaatgaggtgacatttcatgcaaaagactatgatcgcatcatggccgtcatatcaagagaaggagaaaaaattgttttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagatagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggcatggttgaagaaacgcactgcacaggaagctgctgtattcctgacactgtatgagaaagtctttgaagatacatacacatatatgaagctaaatctcaatcccaaaatgcagctcttggagtgcaactatattgtgcaatctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtgattgggagcactggaataagaaacttcagccttattattatccaactgacagtattccggaatattcatcaattttggttccaaatgttgacaatattagaacaaattttttgatagacaccattgcaaaacaacataaagctgttttgctcacaggagagcagggaactgcaaaaactgtcatggttaaggcctatttgaaaaaatatgatcctgaagtacagctatccaaaagtctaaacttttcatctgccacagaaccaatgatgtttcagagaacaattgaaagctacgtggataagcgaattggaagcacatatgggccaccaggagggagaaaaatgactgtatttattgatgatattaatatgcctgtgattaatgagtggggagatcagataactaatgagattgtgcgacagatgatggaaatggaaggaatgtacagcttggacaagcctggagacttcactactattgttgatgtgcagctcatagcagcaatgatccaccctggaggtggtcgaaatgatattccacaacgtttaaaaagacaatttactgtgtttaattgtacattgccttcaaatgcttcaatagacaaaatttttggaattattggatgtggatactttgatccttgtagaagtttcaagcctcaaatatgtgagatgattgtgaatttagtctcagtgggtagagtgctgtggcaatggactaaggtgaagatgctgccaactccttctaaatttcattacatcttcaatcttcgagatctttccagaatttggcaaggaatgttgaccataaaagctgaggagtgcgcttcaatccctactctcctgtcccttttcaaacacgagtgcagcagagtaattgcagacagatttataactcctgaagatgagcagtggtttaatgcacatcttactcgtgcagttgaagaaaatattggctctgatgcagcgtcgtgtattcttcctgaaccatactttgtggattttcttcgtgagatgccagaaccaactggtgatgaacctgaagactctgtgtttgaagtacccaaaatatatgaattgatgccatcctttgactttctggctgaaaaactccagttttaccagagacagttcaatgaaatcattagaggaacatctcttgatctggtgttttttaaagatgcaatgactcatcttattaagatttcacgaataattcgaacgtcgtgtggaaatgcattgctggtgggtgttggtggttccggaaaacaaagtctttcaagattggcctcttttattgctggctatcaaatattccagataacattaaccaggtcttacaatgtgactaatctaacagatgatttaaaagctttgtacaaagttgctggtgctgatggaaaaggcatcactttcatctttactgacagtgaaataaaagatgaggcatttctagaataccttaacaacttgctatcttcaggggagatctccaacttgtttgcacgagatgagatggatgaaatcacccaaggtctgatttcagtgatgaagagggagctacctcgccatcctcctacctttgataatttgtatgaatacttcatttcaagatcaaggaagaacttacatgttgttctctgcttttctccagttggtgagaagttccgtgcccgttctttgaaatttcctggcttgatatcaggttgcactatggactggttcagccgctggccaagggaggctctgattgctgtggcctcctacttcctttcagactataatattgtctgctctagtgaaattaaaagacaagttgtagaaacaatgggcctgtttcatgacatggtttcagagagctgtgaaagttatttccaaagataccgccgaagagcacatgtgactcccaaatcttacctctcatttataaatggttataaaaacatttatgctgaaaaggtgaagttcattaatgaacaggctgaacgtatgaatattggtcttgataaactaatggaggcaagtgaatctgttgctaaactctctcaggatcttgcagtcaaggagaaggagttggcagtggcttccataaaagcagacgaagtattagcagaagtcacagtaagcgctcaggcttcagccaaaattaaaaatgaagtacaggaggtaaaggacaaagcccaaaaaattgtggatgaaattgatagtgaaaaagtgaaagctgaaagcaagcttgaggcagctaaacctgcactggaagaagcagaagcagccctgaatactatcaagccaaatgatattgccacagtcaggaaacttgcaaaaccaccacatcttattatgagaatcatggactgtgttctgttactatttcaaaagaaaattgaccctgttactatggatccagaaaaatcttgctgtaagccatcatggggagagtcattaaagttgatgagtgcaacaggattcctgtggagccttcagcagttccctaaggacactataaatgaagagactgttgagttactacagccatattttaatatggatgattatacttttgaaagtgccaaaaaagtctgtgggaatgtggctggtctcctgtcttggacacttgctatggcaatattttatggcatcaatagagaagtgttgcctctgaaggccaacctggccaagcaggaaggccggttagcagttgctaatgctgagttagggaaggcacaagccctgctggatgagaagcaagctgagctggataaagtacaggcaaaatttgatgcagcaatgaatgagaaaatggatttgcttaatgacgctgatacgtgccggaaaaagatgcaggccgcctccactctcatcgatgggctgagtggagaaaaaatccggtggacccagcaaagtaaagaattcaaagctcagattaatagacttgtaggtgatattctgctgtgcacgggattcctttcctaccttggtcctttcaatcagatatttaggaactatttgcttaaagatcaatgggaaatggagttgagagcacggaaaattcctttcacagaaaacctgaatcttatttcaatgttggtggatcctccaactattggtgagtgggggctacagggattaccaggagatgatctctcaattcagaatggcattattgtgacaaaggccaccagatacccactcctcatagacccacaaactcaaggcaaaacttggattaaatcaaaggaaaaagaaaatgatttacaggtgacatctctgaaccataaatattttcgcacacacttggaggacagcctttccttgggccgaccccttctcattgaggacattcatgaagagctggatccagccttggataatgtattagaaaagaattttattaaatctggcaccactttcaaggtgaaagtcggtgataaggaatgtgatatcatggatacatttaaactttacattactacgaagttaccaaatcctgcctttaccccagagattaatgctaaaacgtcagtcattgatttcactgttacaatgaaaggacttgagaatcagttactaaggagagtcattctaacagagaaacaggagttagaggctgagagggttaaacttttggaggatgttacttttaataagcggaagatgaaagaacttgaagataacctcctctataaattaagtgctacaaaaggctcattggtagatgacgaatctctcattggtgtacttcgaactaccaagcagacagcagctgaggtaagtgaaaagttgcatgtggctgcagaaactgagatcaagatcaacgcggctcaggaggagttccggcccgcagccacccgcggaagcatcctctacttcctcatcacagagatgagcatggtcaacatcatgtatcagacgtcattggcccagttcttgaagttatttgaccagtccatggccagatctgaaaagtcaccactacctcaaaagagaattacaaatattatcgagtacctgacatatgaagtttttacatactctgtcagaggcctatacgaaaaccacaaattcctgtttgtactcctcatgaccttaaagattgaccttcagagagggacagttaagcacagagagtttcaagctctcattaaagggggagcagctctggacctgaaagcctgtcctcccaaaccctatcgctggatccttgacatgacttggctgaatcttgtggagctgagtaaacttccacaatttgcagaaattatgaaccagatatctcgtaatgagaaggggtggaaaagctggtttgataaagatgctccagaggaggaaattatccctgatggatataatgattcactagatacctgccataaacttttacttatcaggtcttggtgcccagaccgtactgtttttcaagcaagaaagtatattgcagattctttggaggagaagtacacagaaccagttatcttaaatctggagaaaacttgggaagaaagtgatacccggacacctctgatatgcttcctgtccatgggatctgaccccaccaatcaaattgatgcattggccaagaaactgaaactggaatgtagaactatctcaatggggcaaggacaagaagtacatgctcgaaagctgattcagatgtcaatgcagcagggtggttgggtattactacaaaattgccaccttggcctggaattcatggaagaattactagagacgctaattaccactgaagccagtgatgattctttccgagtatggataactacggagccccatgatcgatttccaattacattgcttcagacctctctcaaattcactaatgagccaccccaaggtgtacgcgcaggtttgaaaagaacatttgctggaattaatcaagaccttctggacatcagtaatttacccatgtggaagccgatgctttacacagtagcatttttacactccactgtgcaggagcgacgaaaatttggccccttaggatggaatattccctacgaattcaattctgctgacttttcagccagtgttcagtttattcagaatcaccttgatgaatgcgatattaagaaaggtgtatcatggaatacggttcggtacatgatcggagaagtacaatatggaggcagagtgacagatgactttgacaaacgtctacttaattgctttgccagagtctggttcagtgagaagatgtttgaaccgtcattctgcttttatactggatataaaatccccttatgcaaaaccttagaccagtattttgaatacatccagtcactgccatccctagataaccctgaagtctttgggcttcaccctaatgctgatatcacgtatcagagtaacactgcttctgctgttcttgaaacaattaccaacattcaacccaaagagagtggaggtggtgtgggagagacccgggaggctattgtttatagattatctgaagatatgctgagtaaactccctcctgattacattcctcatgaggtgaaatctcgtttgataaagatgggccatcttaattcaatgaacatatttcttagacaagaaattgacagaatgcaaagagtcatttcaatactccgcagtagcctgagtgatctaaaattggccattgaaggaacaatcattatgagtgagaatctgagagatgctctggacaacatgtatgatgctcgtatacctcagctctggaaaagagtgtcttgggattcgtccacactgggcttctggttcactgaacttttggaaagaaatgctcagttttctacgtggatatttgaagggaggcctaatgtgttttggatgactggtttctttaatccccaaggcttcctcacagcaatgaggcaagaagtgacccgtgcccacaaaggctgggcactggacactgtgaccatccacaatgaagttctgagacagaccaaggaggagatcacgtcaccccctggggaaggtgtgtatatttatgggctctacatggatggagcagcctgggacagacggaatgggaagctcatggaatccacccccaaggtactcttcacgcagttacccgtgctccacatctttgccattaactccacggcacccaaggaccccaagctgtatgtgtgtcctatttacaagaaacccaggcgaactgatttgaccttcatcactgtggtatatttacgaacagtgttgtccccggatcactggatcctgagaggagtggcccttttgtgtgacatcaagtaa

SEQ ID NO: 9004 - DNA, 13049 bp, Homo sapiens
cccggggcagcgcaaccgctggggccggcctcagtgggctgagtggtcggggcatcggggcccagagagcggctggtttcgaagtataaagcattccgcacgacgggggatggagaaggatgctgaagatggcgccccttctgagggagcagaggctcctccctctacggaagaggctgcccctccccgttcagaagaggaagaggccccgcgccctccgacagtggaggccccggcagaagatggtttctctccttccgcagaagatgctgtttcttctgtggtggattatcgggatctcattccttctgaagaagggatagttcttccagatgatcatgaagcggatctgaatagagttcgacagaggcttgcaccgcgaccggttcagtcagtgatttcggaagtgctgtccttgccgtcttcccggaggtcctccagataccgccggagtatgagtggccttcccaatctacaggaaacattaaaagagagacaggcaagatttagagaggcaagggaaagccgaagactgaaaattgacccttcatacaaatatatatttgaaattctagcagaaaatcttggcctggacatagtaactgttgaagaattaattttggattgcccatctctggaagcatttactaatttttttgcgaaagatggttgtaagacactgaaatttttgtaccaagaaggagatgtacctggtattgaatgtggtcgaactattgctggagcaactaaaggggcaaaaatgatgaaattgtatatagacaatgcagccccggataaactaaaaggactgtgcatattttttgttcgttgccgtaatgatgttgctataaatgttaaaactattcaagaggaagcgctctttactgttctggatgcgtcgaaaggactcttaaatggaattagggatatgttggcaaatatatttctaccagctgttcttgcaacaaacaactggggtgctttaaaccagtccaagcagggagaatctgaaaaacatattttcactgaaaccatcaacagatatctttcatttttagatggtgctagaataagtattgagggaacagtgaagttaaagacaatagacaatgttaatttttccaaactgcacacctttgaagaagtaactgctgcagccagcaactcagaaactgttcatcagctggaggaagtgctgatggtatggtacaaacagatcgaacaggtacttattgagagtgagcagatgagaaaagaagctggtgattcaggtccactcactgaattggaacactggaaacgcatgtcagccaagttcaactatatcattgagcagattaaagggccaagttgtaaggctgtcataaatgtgctaaatgttgcacactccaaactgctaaagaattggcgtgatttggatgcaagaatcactgatacagcaaatgaatccaaagataatgtcagatatttgtatactttggaaaaagtgtgtcaacctctctataaccatgacctagtttccatggcacatggaatacaaaatttgattaatgccatcagaatgattcacggtgtgtcaaggtattataatacctcagagagaatgacctcattgtttatcaaggtaacaaatcaaatggtaacagcatgtaaagcatatattactgatggaggattaaaccatgtatgggatcaggaaacgccagttgtactaaagaaaattcaggactgcatttttctattcaaggaatatcaggcatcttttcataaaacaaggaaactgatttcagaatcctcaggggaaaaatcttttgaggtttcagaaatgtatatatttggaaaatttgaagctttttgcaaaagactggagaagattacagaaatgataactgttgtgcaaacatattcaaccttgagtaattctaccatagaaggaatagatattatggcaataaaattcagaaatatataccaaggggttaagaaaaagcaatatgacattctggatccaagaaggacagaatttgacacagatttcttagatttcatgacaaaaatcaatggtttagaggtacaaatacaggcatttatgaacagtagttttgggaaaatcttatcttctcagcaggctcttcagctacttcaaaggtttcagaagctgaacattccctgtctgggattagaaataaaccacacaatagagcgtattcttcagtactatgtggctgaacttgatgctactaagaagctttatcattctcagaaagatgacccccctcttgctcgcaacatgccccctatagcaggaaaaatactctgggtgaggcagctctatcgccggataagtgagcccatcaattatttctttaaaaactcagacattttatcaagtccggacggtaaagctgtcatccgtcagtataacaagatctcctatgtgctggtggaattcgaggtggtctatcacacagcctggatcagagagatttcacagttgcattacgctttacaagccacgctttttgtgcgacatccagaaacagggaagttgctggttaatttcgatcccaaaattttggaagttgttcgggaaactaagtgtatgataaaaatgaagttggatgtaccagaacaggcaaagagattgctaaaattggaaagtaaattgaaagcagacaaactgtatttgcagggtcttctgcaatattatgatgagttatgtcaggaagtgccttctgtgtttgtcaatctgatgaccccaaaaatgaaaaaggtggaatctgtgttgaggcaaggactcacagtgttaacatggtcgtctttaacactggaaagcttctttcaagaagtcgaattagttttggatatgttcaatcaacttttaaagaagatcagtgacttgtgtgaaatgcatattgatacagttctgaaggagatagccaaaactgtgttgatttctctgcctgaaagtggtgctaccaaagtagaagatatgttgaccctcaatgagacatacacaaaagaatgggctgacattctaaaccacaaaagtaagcatgtggaagaagctgtcagagaacttatatcaatatttgagcagatttatgaagtgaaatacactgggaaagtaggaaaacagtcagaacagcggaaacacgttgtttttggaagtgaaacaggagagggtgaaaacaatgactatgaagctaatattgtgaatgagtttgatactcatgataaagaagatgaatttaaaaaggagtgtaaagaggtctttgcttttttctctcatcaattactagacagtcttcaaaaagctacacggttatctctggacacaatgaaaagaagaatatttgttgcaagcctttatgggcgaaagcagtcagaagatattatttcctttataaaaagtgaagtacatcttgcaattcctaatgtggtgatgattcctagtttggatgacattcaacaagccattaaccgtatgatccagttaaccctggaggtcagcagaggagtggctcactgggggcaacagcaaatccgtcccatcaagtctgtcattcccagccccaccactactgacgtgacccatcaaaacacaggaaaactgctgaagaaggaagaaagatcttttgaagaagctattcctgcgaggaagctgaagaatttttacccgggggtagcggagcacaaggatatttctaagttggtcctgctcctttcttcctctgtaaattccctaagaaaggcagctcatgaggccctgcaggactttcagaagtacaagactctctggacagaggaccgcgatgtgaaagtgaaggaatttttggctaacaacccctctctgactgaaatcagatcagaaattctacactatgctacttttgaacaggagattgatgagttgaagcctattattgttgtaggagcacttgaattacatacagagccgatgaaattggccttatccatcgaggccaaggcatggaagatgttactctgtcgatatctgaatgaagaatacaaaaagaaaatgtcatacatgatagcatttattaatgaatacttgaaaaagttatctagacctattcgtgatttagatgatgtcagatttgcaatggaagccttgtcttgcatacgtgataatgaaattcaaatggacatgactttgggaccaattgaagaagcctatgctattttaaacagatttgaagttgaagtaaccaaagaagaatcagaagcagttgataccttaagatattctttcaacaaattgcagagcaaagctgtttcagtacaagaggacctagttcaagtgcagccaaagtttaaaagcaatctacttgagtctgtggaagtttttcgtgaggacgtgataaactttgcagaagcatatgaattggaaggacctatggttccaaatataccaccccaagaagctagcaacaggctacagatatttcaggccagtttcgatgatctgtggaggaaatttgttacgtattcatctggtgaacaactttttggattgcctgtgactgattatgaggttttacacaaaaccagaaaagaactcaacttgctgcagaagctgtatggattgtatgacaccgtaatgagcagtattagtggttattatgaaatactttggggagatgtagatattgaaaaaattaatgcagaactgctggaatttcaaaacagatgtcgtaaacttccaaaaggacttaaagattggcaagcttttttggatctcaaaaagagaattgatgatttcagtgagtcatgtcctctactggaaatgatgaccaataaggccatgaaacagagacactgggatagaatctccgagttaactggaaccccatttgatgtggaatctgattctttttgccttagaaatatcatggaagcaccactccttaaacataaggatgatattgaggatatttgcatatctgccattaaggagaaggatatcgaagccaagctgactcaggtgattgagaattggaccaaccaaaatctgagttttgcagcatttaagggaaaaggagagctcctgctcaaaggaaccgaatcgggagaaattatcactttgatggaggatagtttaatggtcttagggtctttactcagcaacagatacaatgctccatttaaaaaaaatatccagaattgggtgtataaattgtccacttcctcagatataattgaagagtggctcgtagtacagaacctttgggtttatcttgaagccgtctttgtaggtggagatattgccaaacagctgcctcaggaagcaaaacgttttcagaatattgacaagtcttggataaaaataatgcagcgagctcatgagaatcccaatgtgattaattgctgtgttggagatgaaaccatgggacaacttttacctcatttacatgagcagttggaagtatgtcagaagtcactcacagggtatttggagaagaaacgattactgtttccaagattcttctttgtatctgatccagttctcctggaaattcttggacaagccagtgattcccacaccatacagccgcatctccctgcagtatctgacaacatcaatgaggtgacatttcatgcaaaagactatgatcgcatcatggccgtcatatcaagagaaggagaaaaaattgttttggataattctgttatggccaaaggtcctgtggagatttggctactggatttgttaaaaatgcagatgtcatcattacataatataattagatccgctttctatcaaatcagtgattcaggatttcaactcttaccattcctcagccactttccagcacaggttggacttctgggaattcagatgttgtggacacacgattcagaagaggctttacgtaatgcaaaagatgacaggaaaatcatgcaagtgaccaatcagaaatttttggatattctaaatactctcattagtcagacaacacatgatctaagcaagtttgatagagtgaagttcgagactctaattaccatccatgtgcatcagagagatatttttgatgacttggtaaaaatgcatatcaaatcacctactgactttgaatggctaaaacagagtagattttattttaaggaagatttggatcaaactgtggtgtctattacagatgttgattttatttaccaaaatgaatttctgggatgtactgatcgtcttgttatcactccattaacagatagatgctatatcacgttagctcaggccttgggcatgaacatgggaggtgctcccgcaggacctgctggcactggcaaaacagaaaccacaaaagacatgggaaggtgtttgggaaaatatgtggtcgtgttcaattgctcagatcaaatggatttcagaggcctaggaaggattttcaaaggtcttgcacagtcgggttcctggggctgttttgatgagtttaacagaattgaattgcctgtattatcagtggcagcacaacaaatttatattgttttgacagcaagaaaagaaagaaagaaacagttcattttttctgatggtgattgtgttgatttaaatccagaatttggaatcttcttaacgatgaaccctggatatgctgggcgccaggaactaccagaaaacctaaaaatccagtttagaactgttgctatgatggttcctgatagacagatcattatgagagttaaacttgcaagctgtggttttcttgaaaatgttatcttggctcaaaaattttacgttctttacaaactctgtgaagagcaacttactaaacaggttcattatgactttggattgagaaatattctgtctgtattgaggactcttggatctcaaaaaagagccagaccagaagatagtgaattaagcattgtcatgagaggactaagagatatgaacctttccaaactggttgatgaagatgaacccctgttcctcagcttaatcaatgacctgttcccaggactgcaactggatagtaatacttatgcagaactgcaaaacgcagtagcccatcaggttcagatagagggtttgattaaccatccaccctggaacctgaaactcgtgcagttatatgagacgtctttggtacggcatggcttgatgactcttgggcccagtggttctggaaagacaaccgttatcacgattctaatgaaggcgcaaacagaatgcggaaggcctcatagagaaatgcgaatgaatccaaaagccattactgcacctcagatgtttggcagactggacactgctaccaatgactggacagatgggattttttctactctgtggagaaaaacattaaaagctaaaaaaggtgaaaacattttcctcattttagatggtcctgtggatgccatctggattgagaacttaaattccgttttggatgacaataaaactctgacgttagctaatggagatcgcattcccatggcccctagttgtaagcttctgtttgaagtccacaatatcgagaacgcctctcctgccacggtttctaggatgggcatggtctatatcagcagctctgctctcagctggaggccaatcttacaggcatggttgaagaaacgcactgcacaggaagctgctgtattcctgacactgtatgagaaagtctttgaagatacatacacatatatgaagctaaatctcaatcccaaaatgcagctcttggagtgcaactatattgtgcaatctctcaatcttctggaagggttaattccctccaaagaagaaggcggtgtttcctgtgtcgaacatcttcataaattatttgtgtttggcctaatgtggagtttaggagcccttctggaattagaaagcagagaaaagcttgaagccttcttacggcagcatgaaagcaagttggacttaccagaaatacctaaaggctcaaatcaaaccatgtatgagttttatgttactgattatggtgattgggagcactggaataagaaacttcagccttattattatccaactgacagtattccggaatattcatcaattttggttccaaatgttgacaatattagaacaaattttttgatagacaccattgcaaaacaacataaagctgttttgctcacaggagagcagggaactgcaaaaactgtcatggttaaggcctatttgaaaaaatatgatcctgaagtacagctatccaaaagtctaaacttttcatctgccacagaaccaatgatgtttcagagaacaattgaaagctacgtggataagcgaattggaagcacatatgggccaccaggagggagaaaaatgactgtatttattgatgatattaatatgcctgtgattaatgagtggggagatcagataactaatgagattgtgcgacagatgatggaaatggaaggaatgtacagcttggacaagcctggagacttcactactattgttgatgtgcagctcatagcagcaatgatccaccctggaggtggtcgaaatgatattccacaacgtttaaaaagacaatttactgtgtttaattgtacattgccttcaaatgcttcaatagacaaaatttttggaattattggatgtggatactttgatccttgtagaagtttcaagcctcaaatatgtgagatgattgtgaatttagtctcagtgggtagagtgctgtggcaatggactaaggtgaagatgctgccaactccttctaaatttcattacatcttcaatcttcgagatctttccagaatttggcaaggaatgttgaccataaaagctgaggagtgcgcttcaatccctactctcctgtcccttttcaaacacgagtgcagcagagtaattgcagacagatttataactcctgaagatgagcagtggtttaatgcacatcttactcgtgcagttgaagaaaatattggctctgatgcagcgtcgtgtattcttcctgaaccatactttgtggattttcttcgtgagatgccagaaccaactggtgatgaacctgaagactctgtgtttgaagtacccaaaatatatgaattgatgccatcctttgactttctggctgaaaaactccagttttaccagagacagttcaatgaaatcattagaggaacatctcttgatctggtgttttttaaagatgcaatgactcatcttattaagatttcacgaataattcgaacgtcgtgtggaaatgcattgctggtgggtgttggtggttccggaaaacaaagtctttcaagattggcctcttttattgctggctatcaaatattccagataacattaaccaggtcttacaatgtgactaatctaacagatgatttaaaagctttgtacaaagttgctggtgctgatggaaaaggcatcactttcatctttactgacagtgaaataaaagatgaggcatttctagaataccttaacaacttgctatcttcaggggagatctccaacttgtttgcacgagatgagatggatgaaatcacccaaggtctgatttcagtgatgaagagggagctacctcgccatcctcctacctttgataatttgtatgaatacttcatttcaagatcaaggaagaacttacatgttgttctctgcttttctccagttggtgagaagttccgtgcccgttctttgaaatttcctggcttgatatcaggttgcactatggactggttcagccgctggccaagggaggctctgattgctgtggcctcctacttcctttcagactataatattgtctgctctagtgaaattaaaagacaagttgtagaaacaatgggcctgtttcatgacatggtttcagagagctgtgaaagttatttccaaagataccgccgaagagcacatgtgactcccaaatcttacctctcatttataaatggttataaaaacatttatgctgaaaaggtgaagttcattaatgaacaggctgaacgtatgaatattggtcttgataaactaatggaggcaagtgaatctgttgctaaactctctcaggatcttgcagtcaaggagaaggagttggcagtggcttccataaaagcagacgaagtattagcagaagtcacagtaagcgctcaggcttcagccaaaattaaaaatgaagtacaggaggtaaaggacaaagcccaaaaaattgtggatgaaattgatagtgaaaaagtgaaagctgaaagcaagcttgaggcagctaaacctgcactggaagaagcagaagcagccctgaatactatcaagccaaatgatattgccacagtcaggaaacttgcaaaaccaccacatcttattatgagaatcatggactgtgttctgttactatttcaaaagaaaattgaccctgttactatggatccagaaaaatcttgctgtaagccatcatggggagagtcattaaagttgatgagtgcaacaggattcctgtggagccttcagcagttccctaaggacactataaatgaagagactgttgagttactacagccatattttaatatggatgattatacttttgaaagtgccaaaaaagtctgtgggaatgtggctggtctcctgtcttggacacttgctatggcaatattttatggcatcaatagagaagtgttgcctctgaaggccaacctggccaagcaggaaggccggttagcagttgctaatgctgagttagggaaggcacaagccctgctggatgagaagcaagctgagctggataaagtacaggcaaaatttgatgcagcaatgaatgagaaaatggatttgcttaatgacgctgatacgtgccggaaaaagatgcaggccgcctccactctcatcgatgggctgagtggagaaaaaatccggtggacccagcaaagtaaagaattcaaagctcagattaatagacttgtaggtgatattctgctgtgcacgggattcctttcctaccttggtcctttcaatcagatatttaggaactatttgcttaaagatcaatgggaaatggagttgagagcacggaaaattcctttcacagaaaacctgaatcttatttcaatgttggtggatcctccaactattggtgagtgggggctacagggattaccaggagatgatctctcaattcagaatggcattattgtgacaaaggccaccagatacccactcctcatagacccacaaactcaaggcaaaacttggattaaatcaaaggaaaaagaaaatgatttacaggtgacatctctgaaccataaatattttcgcacacacttggaggacagcctttccttgggccgaccccttctcattgaggacattcatgaagagctggatccagccttggataatgtattagaaaagaattttattaaatctggcaccactttcaaggtgaaagtcggtgataaggaatgtgatatcatggatacatttaaactttacattactacgaagttaccaaatcctgcctttaccccagagattaatgctaaaacgtcagtcattgatttcactgttacaatgaaaggacttgagaatcagttactaaggagagtcattctaacagagaaacaggagttagaggctgagagggttaaacttttggaggatgttacttttaataagcggaagatgaaagaacttgaagataacctcctctataaattaagtgctacaaaaggctcattggtagatgacgaatctctcattggtgtacttcgaactaccaagcagacagcagctgaggtaagtgaaaagttgcatgtggctgcagaaactgagatcaagatcaacgcggctcaggaggagttccggcccgcagccacccgcggaagcatcctctacttcctcatcacagagatgagcatggtcaacatcatgtatcagacgtcattggcccagttcttgaagttatttgaccagtccatggccagatctgaaaagtcaccactacctcaaaagagaattacaaatattatcgagtacctgacatatgaagtttttacatactctgtcagaggcctatacgaaaaccacaaattcctgtttgtactcctcatgaccttaaagattgaccttcagagagggacagttaagcacagagagtttcaagctctcattaaagggggagcagctctggacctgaaagcctgtcctcccaaaccctatcgctggatccttgacatgacttggctgaatcttgtggagctgagtaaacttccacaatttgcagaaattatgaaccagatatctcgtaatgagaaggggtggaaaagctggtttgataaagatgctccagaggaggaaattatccctgatggatataatgattcactagatacctgccataaacttttacttatcaggtcttggtgcccagaccgtactgtttttcaagcaagaaagtatattgcagattctttggaggagaagtacacagaaccagttatcttaaatctggagaaaacttgggaagaaagtgatacccggacacctctgatatgcttcctgtccatgggatctgaccccaccaatcaaattgatgcattggccaagaaactgaaactggaatgtagaactatctcaatggggcaaggacaagaagtacatgctcgaaagctgattcagatgtcaatgcagcaggtatgtgacaagagactgctcctgctgcaacattattgctagaaaccccacaatcatggatgttaccacattcttctcgtgatgctcaatcctggtttttccatttttgtttatcattacctgtgaattttaaacctcagtctagtttcctcctgatattcgcatggaaagcttattccattttctatagtatatgctccattttaccttcaccaattttttgttcgttttatgatttgggagacacaccttctgatttctaagaatgcatctctagcagtcttggaatttcatgatcaatatgaataggtagtacttaaggagtgacagattgagacagttaaatttccattttcagttaaaggcagactttcatttttcattaacggatcatttcaggcaaagaaggaatatt

SEQ ID NO: 9005 - DNA, 14170 bp, Homo sapiens
agcagaggagtgagtcctggccgcgtccccgtcgctagggaaaccgatgcagctggaggccgcgcgcgatgcggctcgcggaggagcgggccgcgctcgcggcggagaacgcggatggggaacccggcgccgaccgacgactgcgactcctggggacctacgtggccatgagcctgcggccggctgcgggcgcctgggagcgttgcgcggggagtgctgaggcggagcagctgctccaggccttcctgggccgcgatgctgccgaggggccgcggccgctgctggtggtgcggcccgggcccaggggcctggcaatacgccccgggctggaggtgggacctgagtcgggcctggctggcgctaaggcgctttttttccttcgcaccgggcccgagcctccagggcccgacagcttccgcggcgcagtggtctgcggggacctgcccgcggcacctctggagcacctagccgcgctgttctcggaggttgttctacccgtcctggccaatgagaagaatcgcctaaactggccccacatgatatgtgaggatgtcaggcggcacgcccacagcctccaatgtgacctctcagttatacttgagcaagtgaagggaaaaactttgctgcctcttccagcaggctcagaaaaaatggagtttgcggattccaaaagtgagacagtcttggattctatagataagtcagtcatctatgccattgagtctgcagtgatcaaatggagctaccaagtccaggtggtactcaagagagagtcttcccagccactcttacaaggggagaatcccacccctaaggtggagttggagttctggaagagcaggtatgaagatctgaaatacatctataatcaactgagaacaataacggtgaggggcatggccaagctcctggacaagcttcagagtagctactttccagctttcaaagccatgtacagagatgttgttgcagctctagcagaggcacaggacatccatgtgcacctgataccgctccagcgccacctggaagctctggagaatgcagaatttccggaggtgaagccccagctgcggcccctgctccacgtggtctgtctgatttgggccacatgcaagtcctaccgctccccgggaaggctgactgtgctgctccaggagatttgcaaccttctcatccagcaggcctctaattatctcagcccagaagacctgctgagaagtgaggtagaagaaagtcagagaaaactgcaagtggtctcagacactttgagcttcttcaagcaagagtttcaggacagaagggagaatctccacacttacttcaaagagaaccaggaagtcaaggaatgggatttccagtcttctttggtctttgtgcgattggatggcttcctgggacaactgcacgtggtggagggtcttctgaagacggccctggatttccacaaactgggaaaggtggagttcagcggcgtcagagggaatgctctgagtcagcaggtccagcaaatgcatgaagaatttcaagagatgtacaggcttctctcaggatcctcctccgactgcctgtacctccaaagcacggactttgaaaatgacgtctctgaatttaaccagaaagtagaagatcttgaccgaagattggggactatctttattcaagcttttgatgatgcacctggcttggagcatgcctttaagctgctagacatagcaggaaacctccttgaaagaccgctggtagcgagggatacatctgataaatacctggtcctcatccaaatgttcaacaaagatctggatgcagtgaggatgatctacagtcagcacgtccaggaggaagcagaacttgggttctccccggtgcacaagaacatgcccaccgtggctggcggcctccgctgggcacaggagctgaggcagcgcatccagggtcctttcagcaactttggacgcatcacacacccttgcatggaatctgcagaaggaaagcgaatgcaacaaaaatatgaagatatgctgtcattgctagaaaagtatgagacaagactttatgaggattggtgccggacagtatcagagaagtcacagtacaatctttcccaaccacttctaaaacgtgacccagagacgaaggagatcactatcaactttaacccacagctgatttcagtgctgaaagaaatgagctatcttgaacccagagagatgaaacacatgcctgagacagcagcagccatgttctcctccagggatttctatcggcagcttgtggctaatttagagttgatggcaaattggtacaacaaggttatgaaaactctgctggaggtggaatttccattagtggaggaagagctgcaaaatattgatctccgcctcagagcagcagaggagactttgaactggaaaacagaaggcatttgcgattatgtcactgaaatcaccagtagtattcatgatcttgaacaaagaattcagaaaactaaagacaatgtggaagagatccaaaacatcatgaaaacatgggtgactccaatatttaagacaaaagatggaaaaagggaatcccttctttctctggatgatcggcatgatcgaatggaaaaatattacaatctcatcaaggaatctggccttaagatccacgcccttgttcaggaaaacctgggtctattttcagcagacccaacctccaatatctggaagacttatgttaactctattgacaatttgttgctgaatggattctttcttgccattgagtgctccctcaagtatcttctggaaaatactgagtgtaaggcaggacttaccccaatatttgaagcacaactgagtctagccatcccagagctagttttctatccgtctctggagtctggagtgaaggggggtttctgtgacattgttgagggtctcatcaccagcatttttaggataccatctctggtgccacggctttccccacaaaatggctctcctcactatcaggtcgacctggacggtataccagatttggcaaacatgcggcgcacactcatggagagagtccagagaatgatgggcctctgctgtggctatcagagcaccttcagccagtattcgtacctctatgtggaggaccggaaggaggttctgggtcagtttctgctgtacgggcacatcctcactccggaagaaattgaagaccatgtggaagatggcatcccagagaaccctcccctcctttctcagtttaaagtgcaaatcgactcctatgaaacgctctatgaagaggtgtgcaggctggaacccatcaaggtgtttgacggctggatgaaaattgatattcgaccctttaaggcatctctgctgaatattattaagaggtggagcctcctgttcaaacagcatcttgtggaccacgtcactcacagcttggccaacctggatgcgtttataaagaagagtgagagcggcttactcaagaaagttgaaaaaggagatttccaaggcttggttgagatcatgggacaccttatggctgttaaagaacggcagagtaacactgatgagatgtttgagcccttaaagcagactattgaattgctgaagacctatgaacaagaattgccagaaacagtgtttaagcagctggaggagctgcctgagaaatggaacaacataaaaaaggtggccattactgtgaagcagcaggtggccccactgcaggcaaatgaagtgacactcctccgccagaggtgcacagccttcgatgcagaacagcagcaattctgggagcaattccacaaagaagccccgttcaggtttgatagcatccaccctcatcaaatgctggatgccaggcacatcgagatccagcagatggaatccactatggcctccatttctgagtctgccagcttatttgaagtcaatgtccctgactataagcagctgaggcagtgcaggaaggaggtctgccagctgaaggagctctgggacaccattggaatggtgacctccagcatccatgcctgggagaccacaccctggaggaatatcaacgtggaagccatggagttggagtgcaaacagtttgcccggcatatccgaaacctggacaaggaggtcagggcctgggatgcattcacaggcctggaaagcactgtgtggaacacgctgagctccctgagggcagtagctgagctgcagaatccagccatccgggagcggcactggaggcagctgatgcaggccaccggtgtgagcttcactatggaccaggacaccaccctagcgcacctgctgcagctccagctgcaccactatgaggatgaggtccggggcattgtggacaaagctgcaaaagagatgggtatggagaaaaccttaaaggagctgcagactacctgggctggcatggaattccagtatgagccccacccacggaccaatgtccccctcctgtgctctgatgaggacctcatagaggttctggaggataatcaagttcaacttcagaacctggtgatgtccaagtatgttgctttcttcttggaggaggtgtcgggctggcagaagaagctgtccacagtggacgctgtcatctctatctggtttgaagtgcagcgaacatggactcacctggaaagcatattcactggatctgaagatattcgggcacagctaccccaggattctaaaaggtttgaaggcatcgacattgactttaaagagctagcttatgatgcccagaaaattccaaatgtagtgcaaaccaccaacaagccaggcctgtatgaaaagctggaggatattcagggcagattgtgcctgtgtgagaaggccctggcagagtacctcgacaccaagaggcttgccttcccgcggttttactttctctcctcctccgatctgttagacatcctttccaacggcacagctccacaacaggttcaacgtcacctttccaaactctttgacaacatggccaagatgcgattccagctagatgccagtggggaaccaaccaagacaagcctcggcatgtacagcaaagaagaggagtatgtggctttcagtgagccctgtgactgcagcgggcaggtagaaatatggctgaaccatgtccttggtcacatgaaggccactgtgaggcatgagatgacagaaggtgtaactgcctatgaagaaaagccgagggagcagtggctttttgaccacccagctcaggtggccctgacctgtactcagatctggtggacaacagaagtgggcatggcatttgccaggctggaggaaggctatgagagtgccatgaaggactattataagaagcaagtggcccagctcaaaacccttatcaccatgctgattggccagctctccaagggagaccggcagaagattatgactatatgcaccatcgatgtgcatgcccgggatgtggtagccaagatgattgctcagaaggtagacaatgcccaggctttcctctggctgtctcagctgcgccatcgttgggatgacgaggtcaaacactgctttgccaacatctgtgatgcccagtttttgtattcctatgagtacctgggaaacacacctcgcttggtgatcacacctttgactgacaggtgctacatcaccctcacccagtccctgcacctgaccatgagtggggctcccgcaggacctgcaggcacaggcaagaccgagaccaccaaggacctgggccgcgcactgggcatcctggtctatgtgttcaactgctcggagcagatggattacaagtcttgtggcaacatctacaaaggccttgctcagactggtgcctggggctgctttgatgagtttaatcgaatctccgtggaggtcttgtcagtggtggcagtgcaggtaaaaagcattcaagatgcgattagagataagaagcagtggttcagcttccttggggaggagatcagcctgaatccttctgtcggtatcttcatcaccatgaacccaggctatgctggccgcacagagctgccagagaatctcaagtctctcttcaggccttgtgcaatggtggttccagactttgaattgatctgtgaaatcatgctggtggcagaaggattcattgaagcccagtcattagccagaaagttcatcactctttaccagttgtgcaaagagcttctctccaaacaggatcactacgactggggcctacgggccatcaagtccgtgctggtggtggcaggatccctgaagagaggagaccctgaccggcctgaggaccaggtcctgatgcgctccttgcgggatttcaacatccccaagattgtgactgatgacatgcccatcttcatgggcctgatcggggacctctttcccgccctggatgtcccccggaggagagaccccaacttcgaagctttggttaggaaggcgatagtggatctgaagctccaggctgaggacaactttgtgctcaaggtggtccagctggaggagctcctggctgtgcggcactctgtatttgtggtgggtggcgctggtaccggcaagtcacaggtgctgaggtccttgcacaagacctatcagatcatgaaacggcgccccgtctggactgacctcaatcccaaagcagtcacaaatgatgagctctttggcatcatcaatccagccacaggagaatggaaggatggattgttctcttccatcatgcgggagcttgccaacatcacccatgatgggcccaagtggattttactggatggcgacatagatccaatgtggattgaatccctgaatactgtcatggatgataacaaggtgctgacattggccagcaatgagaggattcctctgaaccccaccatgaagctcctctttgagatcagccacctgcgcacagccactccagcaactgtctctagagcagggatcttgtacatcaacccggcagacttgggatggaaccctccagtgagcagctggattgagaagagggaaatccagacagagagagccaacttaaccattttgttcgacaagtatcttccaacctgcctagacacactcagaaccaggtttaagaagatcattcccatcccagagcagagcatggttcagatggtgtgtcaccttctggaatgtctcctgaccacggaggacatccctgcagactgccctaaggaaatttatgagcattattttgtgtttgctgccatctgggctttcggcggagcaatggtccaagatcagcttgtggactaccgggcagagttcagcaaatggtggctgactgagttcaaaacagtcaagtttccttcccaaggaaccatctttgactattacatcgacccagagaccaagaaattcgagccttggtccaagctcgtcccccagttcgaatttgaccccgagatgcccttgcaggcgtgtttggtgcacacgagtgagaccatccgtgtgtgctacttcatggagcggttgatggcgcggcagcggcctgtcatgctggtgggcacggctggcactggcaagtcggtgctggtgggagctaagctggccagccttgaccccgaggcatacctggtgaaaaacgtgccattcaactactacaccacgtcagcaatgctgcaggctgtcctggagaagcctctggaaaagaaggctggcagaaactatggccctccagggaacaagaaactcatctatttcattgatgacatgaacatgcctgaggtggatgcctacgggacggtgcagccccacaccatcatccggcagcatctggactatggccactggtatgatcggagcaagctgtccctaaaggagatcacaaatgtacagtatgtttcctgtatgaaccccacggcaggcagcttcaccatcaacccccggcttcagcgtcacttcagcgtgtttgtcctctccttcccgggggcagatgccctgtcctctatctacagcatcatcctcactcagcatctgaagctcggaaacttcccggcgtccctgcagaaatccatccccccactgatcgatctggccctcgccttccaccagaaaattgctaccaccttcctacccacaggaatcaaattccactacatcttcaacctcagagattttgccaacattttccagggcattctcttctcctcagtggaatgtgtgaaatccacatgggatcttataaggctctatctgcatgaatcaaatcgagtttatcgggataagatggtagaagaaaaggactttgatctttttgataaaatccagacagaagtgctcaagaaaacttttgatgatattgaagaccctgtggagcagacccaaagcccgaacctgtattgtcactttgcaaatggtattggggagcccaaatacatgcctgtacagtcttgggaacttttgacccagactctggtggaggccttggagaaccacaatgaagtcaacacagtgatggacctagttctctttgaggatgccatgcgccatgtctgccatatcaatcgcatcttggagtccccgcggggaaatgctctgctggttggtgtaggtgggagcggcaagcagagcctgacaaggctggcagctttcatcagctccatggatgtcttccagatcacactgcgcaaaggctaccagatccaggacttcaagatggacctggccagcctgtgtctgaaagctggagtgaagaatctcaacacagtgtttctcatgactgatgcccaagtggctgatgagaggttccttgtgctcatcaatgatcttttggcatctggggagatcccagatctctactctgatgatgaagttgaaaacatcataagcaatgtgaggaatgaagtcaagagccagggtctggttgacaacagagagaactgttggaagttctttatagatcggatccggcgacagctgaaggtgactctctgtttctcccctgtgggaaacaagctaagagtccgcagcaggaagttcccagccattgtgaactgcacagccatccactggttccacgagtggcctcagcaagcattggagtctgtcagcctccgcttcttgcagaacacagagggcattgagcccacagtaaagcagtcgattagcaaattcatggcctttgtccacacaagtgtcaaccaaacatcccagtcttatctgagcaatgaacagcgctacaactatacaactcccaagtcctttctggagttcatcagactctaccagagcttgttgcacaggcacagaaaagagctcaagtgcaagacagagcggttggagaacgggctgctgaagctgcatagcacctctgcccaggtggatgatctgaaagcaaagctggctgcccaggaagtagagctgaagcagaaaaatgaagatgcagacaaactgattcaggtcgtgggtgtggagactgacaaagtgagcagagagaaagccatggcagatgaagaggagcagaaggtggccgtcatcatgctagaggtgaaacagaagcagaaggactgtgaggaggacctggcaaaggctgagccagcactcacagcagcgcaggcagctctcaacaccctgaacaagaccaacctgacagagctgaagtcatttggctctccgcctctggccgtcagcaatgtcagcgctgcggtgatggtactgatggctcccaggggtagggtgcccaaggaccggagctggaaggctgctaaggtcaccatggccaaagtggatggcttcctggactcgctaataaacttcaacaaagagaacattcacgagaactgcctcaaagccatcaggccgtatctgcaagaccccgagttcaatcctgagtttgtggccaccaaatcctatgcggctgcaggcctctgctcctgggtcatcaatattgtgagattttatgaggtgttctgtgatgtggaacccaagcgccaggcactgaacaaagccaccgcggacctcacagctgcccaggagaagctggctgccatcaaagccaagatcgctcaccttaatgaaaacctggcaaagctcacagccaggtttgagaaagcaacagcagacaaactcaaatgtcagcaagaagccgaagtgaccgcagtcaccatctcccttgccaaccgcctggttggaggactcgcttctgaaaacgtgaggtgggcagatgccgtgcagaacttcaaacagcaggaaaggacgttatgtggagacattttacttataacggctttcatttcctaccttggcttcttcacaaagaaataccggcagagcctcctggacagaacttggaggccctacctgagccagctgaaaactcccattccagtcaccccagccctggatcccctgaggatgctgatggatgatgctgacgtggctgcctggcagaacgagggcctcccagccgaccgcatgtccgtggagaatgccaccattctcatcaactgtgagcgctggccactcatggttgaccctcagctacaaggcatcaaatggatcaagaataaatatggtgaagatctccgggtcacgcagattggtcagaaaggctaccttcaaatcatagagcaggccctggaagctggagctgtggtgctgattgaaaatctagaggagtccattgatcctgttctgggacccctgcttgggagagaagtcattaaaaaaggacgattcattaaaattggagacaaagaatgtgaatacaatcccaagttccggctcatcctccacaccaagctggctaatcctcactaccagcctgagctgcaggctcaggccaccctgatcaacttcaccgtgaccagggatggcctggaggaccagttgctggccgctgtggtcagcatggagaggccagacttggagcagctgaagtccgatctcacaaagcagcagaatggattcaaaattaccctgaaaacgttggaagacagtcttctctctcgcctctcctccgcctctgggaacttcctgggagaaacagtgctggtggaaaacctagagatcaccaagcagactgctgccgaagttgagaaaaaggtccaggaggccaaggtgactgaagtgaaaatcaacgaggcccgagagcactaccggccagcagctgccagggcctcactgctctacttcatcatgaacgacctcagcaagatccatccaatgtaccagttttctctcaaggccttcagtatcgtcttccagaaggctgtggagagggctgctcctgacgaaagcctcagggagcgggtggccaacctaatagacagcataaccttctctgtgtaccagtacaccatccgcgggctctttgagtgtgataagctgacctaccttgcccagctcacctttcagattctcctcatgaaccgagaagtcaatgcagtggagttggatttcctgcttcgatctccagtgcagacgggcaccgccagccccgtggagttcctctcccatcaggcgtggggagctgtcaaggtactttcatcaatggaagaattctctaatctggatcgggacatagagggatctgctaagagctggaaaaagtttgtggagtccgaatgtcctgagaaagagaagctcccacaggagtggaagaacaagacagccctgcagcgcctctgcatgctgagagccatgcggcccgaccggatgacctatgctttgcgagattttgttgaagagaagttaggaagcaaatacgtggtgggaagagccctagattttgcaacctcatttgaagaatcgggaccagccactcctatgtttttcatcctgtctccaggggtggacccactgaaggatgtagaaagtcaaggaagaaaacttggatacaccttcaacaatcagaactttcacaacgtgtctttggggcaaggacaggaagtggtggctgaggctgcgctggacctcgctgccaagaaaggtcactgggttattttgcagaacattcacctggtggccaagtggctcagcaccctggagaagaagctggaggagcacagtgagaacagccacccagagttcagggtcttcatgagtgcagagccagcaccctcccctgagggccacatcatcccccagggcatcctggagaactccattaagatcaccaatgagccccccacgggcatgcatgccaacctgcacaaggccctggacaacttcactcaggacactctggagatgtgttctcgggagacggagtttaagagcatcctctttgctctttgttacttccatgcggtggtggcagaaagacgaaaatttgggccccagggatggaatcgctcatacccctttaacactggagacctcactatctctgtgaatgtcctctacaacttcctggaggccaacgcaaaggtcccctatgatgatttgcgctacctgtttggagagatcatgtatggaggccatatcacagatgactgggacagaagactctgcagaacctacctgggggaattcattcgaccagaaatgttagaaggagaactgtctttggccccagggttcccactcccaggcaacatggactacaatggttatcatcagtacatcgatgctgagctgcccccagaatccccctacctctatggcctccacccgaacgcagagattggcttcctgacccaaacctcagaaaagctcttccgcactgtgctggagctgcagcctcgggacagccaggccagagacggagcgggcgccacaagagaagaaaaggtcaaggcacttctggaagaaatattggagcgggtgacagacgagtttaacatcccagaactgatggccaaagtggaggagcgcaccccttacattgtagttgccttccaggagtgtggccggatgaatatcctcaccagagagattcagcgctcactgagggagctggagctcggcttaaagggggagctgactatgaccagccacatggagaacttacagaatgccctgtacttcgatatggtgccagagtcctgggctagacgagcctacccttccacagcaggcctggcagcctggtttccagacctcctcaacagaatcaaggagctagaggcttggacgggtgactttacaatgccctccactgtgtggctgacaggcttcttcaacccccagtcgttcctgactgccatcatgcagtccacggctcgcaagaatgagtggccactggaccagatggccctgcaatgtgacatgacgaagaagaacagagaagagtttaggagtcctcctcgggaaggggcctacatccatggcctcttcatggaaggtgcctgctgggacacacaggctgggatcattacagaggcaaagctgaaggatctgacaccccctatgcctgtgatgttcatcaaggccattcctgcagataagcaggactgccgcagtgtctattcctgtcctgtgtacaagactagtcagcggggacccacctacgtgtggactttcaacctgaagactaaggaaaacccatccaagtgggttctggctggagtagccttgcttctccagatttagcatcctgcagagccaccgagaaaataaaaaagctgggcttggaggctgcctagagggacaggtgggtgaagggtcaccacagacacttagaacggtaagaaaccatgagcactcacaattctgtagaattcctctagggaacttggagaggtgtgcctaaggtgaggctgagctgaaggaatgtgggcccaggtttcttaataaaatgatttactcttcaactgtgtctggcccaggatttgagagctgctgaatcataaatgatcatgtagagaccaagagaaacaaaccacaagggccctgaccttgttacacaacactatcctaggtgctcttcttccaggctaccccacgcagtccttggaccagtggtattggcatcacccatgaaccagaatctccattttaacaatctctctggaaaatctgtatgcacattatagtttgagaaacactatcctggagcaggggtcaccaacatttttccataaagagccagttagtgaatacttttagtgatttacaggccacaatgcctctgtttgaactttgcaactttgccgtggtagaccaacagtaaccataaatgatgagtaaatgaaggggtgtgattgcattctaacaaattttatttacaaaaa

SEQ ID NO: 9006 - DNA, 1460 bp, Homo sapiens
agaagacggggtgtgatgggaaaggggcccaacccctgctctgttccagcataccaccaaacctccaacaaggccttttgcagtctcagtctcgcgcttgcatcagaagggcattggagatattggccctgagcaggacagagcatatctgtaacagtgtccaggaacaatatacctttgacggaagatgcttattgccagattattgggatttctccaaatatgaaagacttcgttctaggtagagacaaggtccaggaggccaaggtgactgaagtgaaaatcaacgaggcccgagagcactaccggccagcagctgccagggcctcactgctctacttcatcatgaacgacctcagcaagatccatccaatgtaccagttttctctcaaggccttcagtatcgtcttccagaaggctgtggagagggctgctcctgacgaaagcctcagggagcgggtggccaacctaatagacagcataaccttctctgtgtaccagtacaccatccgcgggctctttgagtgtgataagctgacctaccttgcccagctcacctttcagattctcctcatgaaccgagaagtcaatgcagtggagttggatttcctgcttcgatctccagtgcagacgggcaccgccagccccgtggagttcctctcccatcaggcgtggggagctgtcaaggtactttcatcaatggaagaattctctaatctggatcgggacatagagggatctgctaagagctggaaaaagtttgtggagtccgaatgtcctgagaaagagaagctcccacaggagtggaagaacaagacagccctgcagcgcctctgcatgctgagagccatgcggcccgaccggatgacctatgctttgcgagattttgttgaagagaagttaggaagcaaatacgtggtgggaagagccctagattttgcaacctcatttgaagaatcgggaccagccactcctatgtttttcatcctgtctccaggggtggacccactgaaggatgtagaaagtcaaggaagaaaacttggatacaccttcaacaatcagaactttcacaacgtgtctttggggcaaggacaggaagtggtggctgaggctgcgctggacctcgctgccaagaaaggtcactgggttattttgcaggtaaagagatgttccttctttaccttttatcacccagcccactgccttgaacatagcagacactgaaacaaaaggccggtgggtcaaggaatccatgaagaaattaaagaaagaataaatgcaaaagccagtcactcccattcttcccggctttcactaccatgaacctcccccatctcctgattactggtgacatcacatcttgctgctgggtctttgtccttaattattcagttatttatttggagcctagcaactgagagatctgcccctcccagggcctccttttccagaaacatcag

SEQ ID NO: 9007 - DNA, 3145 bp, Homo sapiens
gttttaagaaacaagaaaggtcagggtggctgtggttggaacctccaacaggaaggttgttcttcccacgaatccaaaggctgtacaagggcaaagacactacagctgcctgaagttagtgctttaggatatggagcataaagagaggaagagatgagatccacttggataccagcaccccactccagcctcgaggaagcttttacacagtctgccatggttttacacagtttaaaactggaagacagattctgctgatttttttttaatccgatctcacaaagcagcagaatggattcaaaattaccctgaaaacgttggaagacagtcttctctctcgcctctcctccgcctctgggaacttcctgggagaaacagtgctggtggaaaacctagagatcaccaagcagactgctgccgaagttgagaaaaaggtccaggaggccaaggtgactgaagtgaaaatcaacgaggcccgagagcactaccggccagcagctgccagggcctcactgctctacttcatcatgaacgacctcagcaagatccatccaatgtaccagttttctctcaaggccttcagtatcgtcttccagaaggctgtggagagggctgctcctgacgaaagcctcagggagcgggtggccaacctaatagacagcataaccttctctgtgtaccagtacaccatccgcgggctctttgagtgtgataagctgacctaccttgcccagctcacctttcagattctcctcatgaaccgagaagtcaatgcagtggagttggatttcctgcttcgatctccagtgcagacgggcaccgccagccccgtggagttcctctcccatcaggcgtggggagctgtcaaggtactttcatcaatggaagaattctctaatctggatcgggacatagagggatctgctaagagctggaaaaagtttgtggagtccgaatgtcctgagaaagagaagctcccacaggagtggaagaacaagacagccctgcagcgcctctgcatgctgagagccatgcggcccgaccggatgacctatgctttgcgagattttgttgaagagaagttaggaagcaaatacgtggtgggaagagccctagattttgcaacctcatttgaagaatcgggaccagccactcctatgtttttcatcctgtctccaggggtggacccactgaaggatgtagaaagtcaaggaagaaaacttggatacaccttcaacaatcagaactttcacaacgtgtctttggggcaaggacaggaagtggtggctgaggctgcgctggacctcgctgccaagaaaggtcactgggttattttgcagaacattcacctggtggccaagtggctcagcaccctggagaagaagctggaggagcacagtgagaacagccacccagagttcagggtcttcatgagtgcagagccagcaccctcccctgagggccacatcatcccccagggcatcctggagaactccattaagatcaccaatgagccccccacgggcatgcatgccaacctgcacaaggccctggacaacttcactcaggacactctggagatgtgttctcgggagacggagtttaagagcatcctctttgctctttgttacttccatgcggtggtggcagaaagacgaaaatttgggccccagggatggaatcgctcatacccctttaacactggagacctcactatctctgtgaatgtcctctacaacttcctggaggccaacgcaaaggtcccctatgatgatttgcgctacctgtttggagagatcatgtatggaggccatatcacagatgactgggacagaagactctgcagaacctacctgggggaattcattcgaccagaaatgttagaaggagaactgtctttggccccagggttcccactcccaggcaacatggactacaatggttatcatcagtacatcgatgctgagctgcccccagaatccccctacctctatggcctccacccgaacgcagagattggcttcctgacccaaacctcagaaaagctcttccgcactgtgctggagctgcagcctcgggacagccaggccagagacggagcgggcgccacaagagaagaaaaggtcaaggcacttctggaagaaatattggagcgggtgacagacgagtttaacatcccagaactgatggccaaagtggaggagcgcaccccttacattgtagttgccttccaggagtgtggccggatgaatatcctcaccagagagattcagcgctcactgagggagctggagctcggcttaaagggggagctgactatgaccagccacatggagaacttacagaatgccctgtacttcgatatggtgccagagtcctgggctagacgagcctacccttccacagcaggcctggcagcctggtttccagacctcctcaacagaatcaaggagctagaggcttggacgggtgactttacaatgccctccactgtgtggctgacaggcttcttcaacccccagtcgttcctgactgccatcatgcagtccacggctcgcaagaatgagtggccactggaccagatggccctgcaatgtgacatgacgaagaagaacagagaagagtttaggagtcctcctcgggaaggggcctacatccatggcctcttcatggaaggtgcctgctgggacacacaggctgggatcattacagaggcaaagctgaaggatctgacaccccctatgcctgtgatgttcatcaaggccattcctgcagataagcaggactgccgcagtgtctattcctgtcctgtgtacaagactagtcagcggggacccacctacgtgtggactttcaacctgaagactaaggaaaacccatccaagtgggttctggctggagtagccttgcttctccagatttagcatcctgcagagccaccgagaaaataaaaaagctgggcttggaggctgcctagagggacaggtgggtgaagggtcaccacagacacttagaacggtaagaaaccatgagcactcacaattctgtagaattcctctagggaacttggagaggtgtgcctaaggtgaggctgagctgaaggaatgtgggcccaggtttcttaataaaatgatttactcttcaa

SEQ ID NO: 9008 - DNA, 9198 bp, Homo sapiens
gaggtccggggcattgtggacaaagctgcaaaagagatgggtatggagaaaaccttaaaggagctgcagactacctgggctggcatggaattccagtatgagccccacccacggaccaatgtccccctcctgtgctctgatgaggacctcatagaggttctggaggataatcaagttcaacttcagaacctggtgatgtccaagtatgttgctttcttcttggaggaggtgtcgggctggcagaagaagctgtccacagtggacgctgtcatctctatctggtttgaagtgcagcgaacatggactcacctggaaagcatattcactggatctgaagatattcgggcacagctaccccaggattctaaaaggtttgaaggcatcgacattgactttaaagagctagcttatgatgcccagaaaattccaaatgtagtgcaaaccaccaacaagccaggcctgtatgaaaagctggaggatattcagggcagattgtgcctgtgtgagaaggccctggcagagtacctcgacaccaagaggcttgccttcccgcggttttactttctctcctcctccgatctgttagacatcctttccaacggcacagctccacaacaggttcaacgtcacctttccaaactctttgacaacatggccaagatgcgattccagctagatgccagtggggaaccaaccaagacaagcctcggcatgtacagcaaagaagaggagtatgtggctttcagtgagccctgtgactgcagcgggcaggtagaaatatggctgaaccatgtccttggtcacatgaaggccactgtgaggcatgagatgacagaaggtgtaactgcctatgaagaaaagccgagggagcagtggctttttgaccacccagctcaggtggccctgacctgtactcagatctggtggacaacagaagtgggcatggcatttgccaggctggaggaaggctatgagagtgccatgaaggactattataagaagcaagtggcccagctcaaaacccttatcaccatgctgattggccagctctccaagggagaccggcagaagattatgactatatgcaccatcgatgtgcatgcccgggatgtggtagccaagatgattgctcagaaggtagacaatgcccaggctttcctctggctgtctcagctgcgccatcgttgggatgacgaggtcaaacactgctttgccaacatctgtgatgcccagtttttgtattcctatgagtacctgggaaacacacctcgcttggtgatcacacctttgactgacaggtgctacatcaccctcacccagtccctgcacctgaccatgagtggggctcccgcaggacctgcaggcacaggcaagaccgagaccaccaaggacctgggccgcgcactgggcatcctggtctatgtgttcaactgctcggagcagatggattacaagtcttgtggcaacatctacaaaggccttgctcagactggtgcctggggctgctttgatgagtttaatcgaatctccgtggaggtcttgtcagtggtggcagtgcaggtaaaaagcattcaagatgcgattagagataagaagcagtggttcagcttccttggggaggagatcagcctgaatccttctgtcggtatcttcatcaccatgaacccaggctatgctggccgcacagagctgccagagaatctcaagtctctcttcaggccttgtgcaatggtggttccagactttgaattgatctgtgaaatcatgctggtggcagaaggattcattgaagcccagtcattagccagaaagttcatcactctttaccagttgtgcaaagagcttctctccaaacaggatcactacgactggggcctacgggccatcaagtccgtgctggtggtggcaggatccctgaagagaggagaccctgaccggcctgaggaccaggtcctgatgcgctccttgcgggatttcaacatccccaagattgtgactgatgacatgcccatcttcatgggcctgatcggggacctctttcccgccctggatgtcccccggaggagagaccccaacttcgaagctttggttaggaaggcgatagtggatctgaagctccaggctgaggacaactttgtgctcaaggtggtccagctggaggagctcctggctgtgcggcactctgtatttgtggtgggtggcgctggtaccggcaagtcacaggtgctgaggtccttgcacaagacctatcagatcatgaaacggcgccccgtctggactgacctcaatcccaaagcagtcacaaatgatgagctctttggcatcatcaatccagccacaggagaatggaaggatggattgttctcttccatcatgcgggagcttgccaacatcacccatgatgggcccaagtggattttactggatggcgacatagatccaatgtggattgaatccctgaatactgtcatggatgataacaaggtgctgacattggccagcaatgagaggattcctctgaaccccaccatgaagctcctctttgagatcagccacctgcgcacagccactccagcaactgtctctagagcagggatcttgtacatcaacccggcagacttgggatggaaccctccagtgagcagctggattgagaagagggaaatccagacagagagagccaacttaaccattttgttcgacaagtatcttccaacctgcctagacacactcagaaccaggtttaagaagatcattcccatcccagagcagagcatggttcagatggtgtgtcaccttctggaatgtctcctgaccacggaggacatccctgcagactgccctaaggaaatttatgagcattattttgtgtttgctgccatctgggctttcggcggagcaatggtccaagatcagcttgtggactaccgggcagagttcagcaaatggtggctgactgagttcaaaacagtcaagtttccttcccaaggaaccatctttgactattacatcgacccagagaccaagaaattcgagccttggtccaagctcgtcccccagttcgaatttgaccccgagatgcccttgcaggcgtgtttggtgcacacgagtgagaccatccgtgtgtgctacttcatggagcggttgatggcgcggcagcggcctgtcatgctggtgggcacggctggcactggcaagtcggtgctggtgggagctaagctggccagccttgaccccgaggcatacctggtgaaaaacgtgccattcaactactacaccacgtcagcaatgctgcaggctgtcctggagaagcctctggaaaagaaggctggcagaaactatggccctccagggaacaagaaactcatctatttcattgatgacatgaacatgcctgaggtggatgcctacgggacggtgcagccccacaccatcatccggcagcatctggactatggccactggtatgatcggagcaagctgtccctaaaggagatcacaaatgtacagtatgtttcctgtatgaaccccacggcaggcagcttcaccatcaacccccggcttcagcgtcacttcagcgtgtttgtcctctccttcccgggggcagatgccctgtcctctatctacagcatcatcctcactcagcatctgaagctcggaaacttcccggcgtccctgcagaaatccatccccccactgatcgatctggccctcgccttccaccagaaaattgctaccaccttcctacccacaggaatcaaattccactacatcttcaacctcagagattttgccaacattttccagggcattctcttctcctcagtggaatgtgtgaaatccacatgggatcttataaggctctatctgcatgaatcaaatcgagtttatcgggataagatggtagaagaaaaggactttgatctttttgataaaatccagacagaagtgctcaagaaaacttttgatgatattgaagaccctgtggagcagacccaaagcccgaacctgtattgtcactttgcaaatggtattggggagcccaaatacatgcctgtacagtcttgggaacttttgacccagactctggtggaggccttggagaaccacaatgaagtcaacacagtgatggacctagttctctttgaggatgccatgcgccatgtctgccatatcaatcgcatcttggagtccccgcggggaaatgctctgctggttggtgtaggtgggagcggcaagcagagcctgacaaggctggcagctttcatcagctccatggatgtcttccagatcacactgcgcaaaggctaccagatccaggacttcaagatggacctggccagcctgtgtctgaaagctggagtgaagaatctcaacacagtgtttctcatgactgatgcccaagtggctgatgagaggttccttgtgctcatcaatgatcttttggcatctggggagatcccagatctctactctgatgatgaagttgaaaacatcataagcaatgtgaggaatgaagtcaagagccagggtctggttgacaacagagagaactgttggaagttctttatagatcggatccggcgacagctgaaggtgactctctgtttctcccctgtgggaaacaagctaagagtccgcagcaggaagttcccagccattgtgaactgcacagccatccactggttccacgagtggcctcagcaagcattggagtctgtcagcctccgcttcttgcagaacacagagggcattgagcccacagtaaagcagtcgattagcaaattcatggcctttgtccacacaagtgtcaaccaaacatcccagtcttatctgagcaatgaacagcgctacaactatacaactcccaagtcctttctggagttcatcagactctaccagagcttgttgcacaggcacagaaaagagctcaagtgcaagacagagcggttggagaacgggctgctgaagctgcatagcacctctgcccaggtggatgatctgaaagcaaagctggctgcccaggaagtagagctgaagcagaaaaatgaagatgcagacaaactgattcaggtcgtgggtgtggagactgacaaagtgagcagagagaaagccatggcagatgaagaggagcagaaggtggccgtcatcatgctagaggtgaaacagaagcagaaggactgtgaggaggacctggcaaaggctgagccagcactcacagcagcgcaggcagctctcaacaccctgaacaagaccaacctgacagagctgaagtcatttggctctccgcctctggccgtcagcaatgtcagcgctgcggtgatggtactgatggctcccaggggtagggtgcccaaggaccggagctggaaggctgctaaggtcaccatggccaaagtggatggcttcctggactcgctaataaacttcaacaaagagaacattcacgagaactgcctcaaagccatcaggccgtatctgcaagaccccgagttcaatcctgagtttgtggccaccaaatcctatgcggctgcaggcctctgctcctgggtcatcaatattgtgagattttatgaggtgttctgtgatgtggaacccaagcgccaggcactgaacaaagccaccgcggacctcacagctgcccaggagaagctggctgccatcaaagccaagatcgctcaccttaatgaaaacctggcaaagctcacagccaggtttgagaaagcaacagcagacaaactcaaatgtcagcaagaagccgaagtgaccgcagtcaccatctcccttgccaaccgcctggttggaggactcgcttctgaaaacgtgaggtgggcagatgccgtgcagaacttcaaacagcaggaaaggacgttatgtggagacattttacttataacggctttcatttcctaccttggcttcttcacaaagaaataccggcagagcctcctggacagaacttggaggccctacctgagccagctgaaaactcccattccagtcaccccagccctggatcccctgaggatgctgatggatgatgctgacgtggctgcctggcagaacgagggcctcccagccgaccgcatgtccgtggagaatgccaccattctcatcaactgtgagcgctggccactcatggttgaccctcagctacaaggcatcaaatggatcaagaataaatatggtgaagatctccgggtcacgcagattggtcagaaaggctaccttcaaatcatagagcaggccctggaagctggagctgtggtgctgattgaaaatctagaggagtccattgatcctgttctgggacccctgcttgggagagaagtcattaaaaaaggacgattcattaaaattggagacaaagaatgtgaatacaatcccaagttccggctcatcctccacaccaagctggctaatcctcactaccagcctgagctgcaggctcaggccaccctgatcaacttcaccgtgaccagggatggcctggaggaccagttgctggccgctgtggtcagcatggagaggccagacttggagcagctgaagtccgatctcacaaagcagcagaatggattcaaaattaccctgaaaacgttggaagacagtcttctctctcgcctctcctccgcctctgggaacttcctgggagaaacagtgctggtggaaaacctagagatcaccaagcagactgctgccgaagttgagaaaaaggtccaggaggccaaggtgactgaagtgaaaatcaacgaggcccgagagcactaccggccagcagctgccagggcctcactgctctacttcatcatgaacgacctcagcaagatccatccaatgtaccagttttctctcaaggccttcagtatcgtcttccagaaggctgtggagagggctgctcctgacgaaagcctcagggagcgggtggccaacctaatagacagcataaccttctctgtgtaccagtacaccatccgcgggctctttgagtgtgataagctgacctaccttgcccagctcacctttcagattctcctcatgaaccgagaagtcaatgcagtggagttggatttcctgcttcgatctccagtgcagacgggcaccgccagccccgtggagttcctctcccatcaggcgtggggagctgtcaaggtactttcatcaatggaagaattctctaatctggatcgggacatagagggatctgctaagagctggaaaaagtttgtggagtccgaatgtcctgagaaagagaagctcccacaggagtggaagaacaagacagccctgcagcgcctctgcatgctgagagccatgcggcccgaccggatgacctatgctttgcgagattttgttgaagagaagttaggaagcaaatacgtggtgggaagagccctagattttgcaacctcatttgaagaatcgggaccagccactcctatgtttttcatcctgtctccaggggtggacccactgaaggatgtagaaagtcaaggaagaaaacttggatacaccttcaacaatcagaactttcacaacgtgtctttggggcaaggacaggaagtggtggctgaggctgcgctggacctcgctgccaagaaaggtcactgggttattttgcaggacactctggagatgtgttctcgggagacggagtttaagagcatcctctttgctctttgttacttccatgcggtggtggcagaaagacgaaaatttgggccccagggatggaatcgctcatacccctttaacactggagacctcactatctctgtgaatgtcctctacaacttcctggaggccaacgcaaaggtcccctatgatgatttgcgctacctgtttggagagatcatgtatggaggccatatcacagatgactgggacagaagactctgcagaacctacctgggggaattcattcgaccagaaatgttagaaggagaactgtctttggccccagggttcccactcccaggcaacatggactacaatggttatcatcagtacatcgatgctgagctgcccccagaatccccctacctctatggcctccacccgaacgcagagattggcttcctgacccaaacctcagaaaagctcttccgcactgtgctggagctgcagcctcgggacagccaggccagagacggagcgggcgccacaagagaagaaaaggtcaaggcacttctggaagaaatattggagcgggtgacagacgagtttaacatcccagaactgatggccaaagtggaggagcgcaccccttacattgtagttgccttccaggagtgtggccggatgaatatcctcaccagagagattcagcgctcactgagggagctggagctcggcttaaagggggagctgactatgaccagccacatggagaacttacagaatgccctgtacttcgatatggtgccagagtcctgggctagacgagcctacccttccacagcaggcctggcagcctggtttccagacctcctcaacagaatcaaggagctagaggcttggacgggtgactttacaatgccctccactgtgtggctgacaggcttcttcaacccccagtcgttcctgactgccatcatgcagtccacggctcgcaagaatgagtggccactggaccagatggccctgcaatgtgacatgacgaagaagaacagagaagagtttaggagtcctcctcgggaaggggcctacatccatggcctcttcatggaaggtgcctgctgggacacacaggctgggatcattacagaggcaaagctgaaggatctgacaccccctatgcctgtgatgttcatcaaggccattcctgcagataagcaggactgccgcagtgtctattcctgtcctgtgtacaagactagtcagcggggacccacctacgtgtggactttcaacctgaagactaaggaaaacccatccaagtgggttctggctggagtagccttgcttctccagatttagcatcctgcagagccaccgagaaaataaaaaagctgggcttggaggctgcctagagggacaggtgggtgaagggtcaccacagacacttagaacggtaagaaaccatgagcactcacaattctgtagaattcctctagggaacttggagaggtgtgcctaaggtgaggctgagctgaaggaatgtgggcccaggtttcttaataaaatgatttactcttc

SEQ ID NO: 9009 - DNA, 13588 bp, Homo sapiens
agcagaggagtgagtcctggccgcgtccccgtcgctagggaaaccgatgcagctggaggccgcgcgcgatgcggctcgcggaggagcgggccgcgctcgcggcggagaacgcggatggggaacccggcgccgaccgacgactgcgactcctggggacctacgtggccatgagcctgcggccggctgcgggcgcctgggagcgttgcgcggggagtgctgaggcggagcagctgctccaggccttcctgggccgcgatgctgccgaggggccgcggccgctgctggtggtgcggcccgggcccaggggcctggcaatacgccccgggctggaggtgggacctgagtcgggcctggctggcgctaaggcgctttttttccttcgcaccgggcccgagcctccagggcccgacagcttccgcggcgcagtggtctgcggggacctgcccgcggcacctctggagcacctagccgcgctgttctcggaggttgttctacccgtcctggccaatgagaagaatcgcctaaactggccccacatgatatgtgaggatgtcaggcggcacgcccacagcctccaatgtgacctctcagttatacttgagcaagtgaagggaaaaactttgctgcctcttccagcaggctcagaaaaaatggagtttgcggattccaaaagtgagacagtcttggattctatagataagtcagtcatctatgccattgagtctgcagtgatcaaatggagctaccaagtccaggtggtactcaagagagagtcttcccagccactcttacaaggggagaatcccacccctaaggtggagttggagttctggaagagcaggtatgaagatctgaaatacatctataatcaactgagaacaataacggtgaggggcatggccaagctcctggacaagcttcagagtagctactttccagctttcaaagccatgtacagagatgttgttgcagctctagcagaggcacaggacatccatgtgcacctgataccgctccagcgccacctggaagctctggagaatgcagaatttccggaggtgaagccccagctgcggcccctgctccacgtggtctgtctgatttgggccacatgcaagtcctaccgctccccgggaaggctgactgtgctgctccaggagatttgcaaccttctcatccagcaggcctctaattatctcagcccagaagacctgctgagaagtgaggtagaagaaagtcagagaaaactgcaagtggtctcagacactttgagcttcttcaagcaagagtttcaggacagaagggagaatctccacacttacttcaaagagaaccaggaagtcaaggaatgggatttccagtcttctttggtctttgtgcgattggatggcttcctgggacaactgcacgtggtggagggtcttctgaagacggccctggatttccacaaactgggaaaggtggagttcagcggcgtcagagggaatgctctgagtcagcaggtccagcaaatgcatgaagaatttcaagagatgtacaggcttctctcaggatcctcctccgactgcctgtacctccaaagcacggactttgaaaatgacgtctctgaatttaaccagaaagtagaagatcttgaccgaagattggggactatctttattcaagcttttgatgatgcacctggcttggagcatgcctttaagctgctagacatagcaggaaacctccttgaaagaccgctggtagcgagggatacatctgataaatacctggtcctcatccaaatgttcaacaaagatctggatgcagtgaggatgatctacagtcagcacgtccaggaggaagcagaacttgggttctccccggtgcacaagaacatgcccaccgtggctggcggcctccgctgggcacaggagctgaggcagcgcatccagggtcctttcagcaactttggacgcatcacacacccttgcatggaatctgcagaaggaaagcgaatgcaacaaaaatatgaagatatgctgtcattgctagaaaagtatgagacaagactttatgaggattggtgccggacagtatcagagaagtcacagtacaatctttcccaaccacttctaaaacgtgacccagagacgaaggagatcactatcaactttaacccacagctgatttcagtgctgaaagaaatgagctatcttgaacccagagagatgaaacacatgcctgagacagcagcagccatgttctcctccagggatttctatcggcagcttgtggctaatttagagttgatggcaaattggtacaacaaggttatgaaaactctgctggaggtggaatttccattagtggaggaagagctgcaaaatattgatctccgcctcagagcagcagaggagactttgaactggaaaacagaaggcatttgcgattatgtcactgaaatcaccagtagtattcatgatcttgaacaaagaattcagaaaactaaagacaatgtggaagagatccaaaacatcatgaaaacatgggtgactccaatatttaagacaaaagatggaaaaagggaatcccttctttctctggatgatcggcatgatcgaatggaaaaatattacaatctcatcaaggaatctggccttaagatccacgcccttgttcaggaaaacctgggtctattttcagcagacccaacctccaatatctggaagacttatgttaactctattgacaatttgttgctgaatggattctttcttgccattgagtgctccctcaagtatcttctggaaaatactgagtgtaaggcaggacttaccccaatatttgaagcacaactgagtctagccatcccagagctagttttctatccgtctctggagtctggagtgaaggggggtttctgtgacattgttgagggtctcatcaccagcatttttaggataccatctctggtgccacggctttccccacaaaatggctctcctcactatcaggtcgacctggacggtataccagatttggcaaacatgcggcgcacactcatggagagagtccagagaatgatgggcctctgctgtggctatcagagcaccttcagccagtattcgtacctctatgtggaggaccggaaggaggttctgggtcagtttctgctgtacgggcacatcctcactccggaagaaattgaagaccatgtggaagatggcatcccagagaaccctcccctcctttctcagtttaaagtgcaaatcgactcctatgaaacgctctatgaagaggtgtgcaggctggaacccatcaaggtgtttgacggctggatgaaaattgatattcgaccctttaaggcatctctgctgaatattattaagaggtggagcctcctgttcaaacagcatcttgtggaccacgtcactcacagcttggccaacctggatgcgtttataaagaagagtgagagcggcttactcaagaaagttgaaaaaggagatttccaaggcttggttgagatcatgggacaccttatggctgttaaagaacggcagagtaacactgatgagatgtttgagcccttaaagcagactattgaattgctgaagacctatgaacaagaattgccagaaacagtgtttaagcagctggaggagctgcctgagaaatggaacaacataaaaaaggtggccattactgtgaagcagcaggtggccccactgcaggcaaatgaagtgacactcctccgccagaggtgcacagccttcgatgcagaacagcagcaattctgggagcaattccacaaagaagccccgttcaggtttgatagcatccaccctcatcaaatgctggatgccaggcacatcgagatccagcagatggaatccactatggcctccatttctgagtctgccagcttatttgaagtcaatgtccctgactataagcagctgaggcagtgcaggaaggaggtctgccagctgaaggagctctgggacaccattggaatggtgacctccagcatccatgcctgggagaccacaccctggaggaatatcaacgtggaagccatggagttggagtgcaaacagtttgcccggcatatccgaaacctggacaaggaggtcagggcctgggatgcattcacaggcctggaaagcactgtgtggaacacgctgagctccctgagggcagtagctgagctgcagaatccagccatccgggagcggcactggaggcagctgatgcaggccaccggtgtgagcttcactatggaccaggacaccaccctagcgcacctgctgcagctccagctgcaccactatgaggatgaggtccggggcattgtggacaaagctgcaaaagagatgggtatggagaaaaccttaaaggagctgcagactacctgggctggcatggaattccagtatgagccccacccacggaccaatgtccccctcctgtgctctgatgaggacctcatagaggttctggaggataatcaagttcaacttcagaacctggtgatgtccaagtatgttgctttcttcttggaggaggtgtcgggctggcagaagaagctgtccacagtggacgctgtcatctctatctggtttgaagtgcagcgaacatggactcacctggaaagcatattcactggatctgaagatattcgggcacagctaccccaggattctaaaaggtttgaaggcatcgacattgactttaaagagctagcttatgatgcccagaaaattccaaatgtagtgcaaaccaccaacaagccaggcctgtatgaaaagctggaggatattcagggcagattgtgcctgtgtgagaaggccctggcagagtacctcgacaccaagaggcttgccttcccgcggttttactttctctcctcctccgatctgttagacatcctttccaacggcacagctccacaacaggttcaacgtcacctttccaaactctttgacaacatggccaagatgcgattccagctagatgccagtggggaaccaaccaagacaagcctcggcatgtacagcaaagaagaggagtatgtggctttcagtgagccctgtgactgcagcgggcaggtagaaatatggctgaaccatgtccttggtcacatgaaggccactgtgaggcatgagatgacagaaggtgtaactgcctatgaagaaaagccgagggagcagtggctttttgaccacccagctcaggtggccctgacctgtactcagatctggtggacaacagaagtgggcatggcatttgccaggctggaggaaggctatgagagtgccatgaaggactattataagaagcaagtggcccagctcaaaacccttatcaccatgctgattggccagctctccaagggagaccggcagaagattatgactatatgcaccatcgatgtgcatgcccgggatgtggtagccaagatgattgctcagaaggtagacaatgcccaggctttcctctggctgtctcagctgcgccatcgttgggatgacgaggtcaaacactgctttgccaacatctgtgatgcccagtttttgtattcctatgagtacctgggaaacacacctcgcttggtgatcacacctttgactgacaggtgctacatcaccctcacccagtccctgcacctgaccatgagtggggctcccgcaggacctgcaggcacaggcaagaccgagaccaccaaggacctgggccgcgcactgggcatcctggtctatgtgttcaactgctcggagcagatggattacaagtcttgtggcaacatctacaaaggccttgctcagactggtgcctggggctgctttgatgagtttaatcgaatctccgtggaggtcttgtcagtggtggcagtgcaggtaaaaagcattcaagatgcgattagagataagaagcagtggttcagcttccttggggaggagatcagcctgaatccttctgtcggtatcttcatcaccatgaacccaggctatgctggccgcacagagctgccagagaatctcaagtctctcttcaggccttgtgcaatggtggttccagactttgaattgatctgtgaaatcatgctggtggcagaaggattcattgaagcccagtcattagccagaaagttcatcactctttaccagttgtgcaaagagcttctctccaaacaggatcactacgactggggcctacgggccatcaagtccgtgctggtggtggcaggatccctgaagagaggagaccctgaccggcctgaggaccaggtcctgatgcgctccttgcgggatttcaacatccccaagattgtgactgatgacatgcccatcttcatgggcctgatcggggacctctttcccgccctggatgtcccccggaggagagaccccaacttcgaagctttggttaggaaggcgatagtggatctgaagctccaggctgaggacaactttgtgctcaaggtggtccagctggaggagctcctggctgtgcggcactctgtatttgtggtgggtggcgctggtaccggcaagtcacaggtgctgaggtccttgcacaagacctatcagatcatgaaacggcgccccgtctggactgacctcaatcccaaagcagtcacaaatgatgagctctttggcatcatcaatccagccacaggagaatggaaggatggattgttctcttccatcatgcgggagcttgccaacatcacccatgatgggcccaagtggattttactggatggcgacatagatccaatgtggattgaatccctgaatactgtcatggatgataacaaggtgctgacattggccagcaatgagaggattcctctgaaccccaccatgaagctcctctttgagatcagccacctgcgcacagccactccagcaactgtctctagagcagggatcttgtacatcaacccggcagacttgggatggaaccctccagtgagcagctggattgagaagagggaaatccagacagagagagccaacttaaccattttgttcgacaagtatcttccaacctgcctagacacactcagaaccaggtttaagaagatcattcccatcccagagcagagcatggttcagatggtgtgtcaccttctggaatgtctcctgaccacggaggacatccctgcagactgccctaaggaaatttatgagcattattttgtgtttgctgccatctgggctttcggcggagcaatggtccaagatcagcttgtggactaccgggcagagttcagcaaatggtggctgactgagttcaaaacagtcaagtttccttcccaaggaaccatctttgactattacatcgacccagagaccaagaaattcgagccttggtccaagctcgtcccccagttcgaatttgaccccgagatgcccttgcaggcgtgtttggtgcacacgagtgagaccatccgtgtgtgctacttcatggagcggttgatggcgcggcagcggcctgtcatgctggtgggcacggctggcactggcaagtcggtgctggtgggagctaagctggccagccttgaccccgaggcatacctggtgaaaaacgtgccattcaactactacaccacgtcagcaatgctgcaggctgtcctggagaagcctctggaaaagaaggctggcagaaactatggccctccagggaacaagaaactcatctatttcattgatgacatgaacatgcctgaggtggatgcctacgggacggtgcagccccacaccatcatccggcagcatctggactatggccactggtatgatcggagcaagctgtccctaaaggagatcacaaatgtacagtatgtttcctgtatgaaccccacggcaggcagcttcaccatcaacccccggcttcagcgtcacttcagcgtgtttgtcctctccttcccgggggcagatgccctgtcctctatctacagcatcatcctcactcagcatctgaagctcggaaacttcccggcgtccctgcagaaatccatccccccactgatcgatctggccctcgccttccaccagaaaattgctaccaccttcctacccacaggaatcaaattccactacatcttcaacctcagagattttgccaacattttccagggcattctcttctcctcagtggaatgtgtgaaatccacatgggatcttataaggctctatctgcatgaatcaaatcgagtttatcgggataagatggtagaagaaaaggactttgatctttttgataaaatccagacagaagtgctcaagaaaacttttgatgatattgaagaccctgtggagcagacccaaagcccgaacctgtattgtcactttgcaaatggtattggggagcccaaatacatgcctgtacagtcttgggaacttttgacccagactctggtggaggccttggagaaccacaatgaagtcaacacagtgatggacctagttctctttgaggatgccatgcgccatgtctgccatatcaatcgcatcttggagtccccgcggggaaatgctctgctggttggtgtaggtgggagcggcaagcagagcctgacaaggctggcagctttcatcagctccatggatgtcttccagatcacactgcgcaaaggctaccagatccaggacttcaagatggacctggccagcctgtgtctgaaagctggagtgaagaatctcaacacagtgtttctcatgactgatgcccaagtggctgatgagaggttccttgtgctcatcaatgatcttttggcatctggggagatcccagatctctactctgatgatgaagttgaaaacatcataagcaatgtgaggaatgaagtcaagagccagggtctggttgacaacagagagaactgttggaagttctttatagatcggatccggcgacagctgaaggtgactctctgtttctcccctgtgggaaacaagctaagagtccgcagcaggaagttcccagccattgtgaactgcacagccatccactggttccacgagtggcctcagcaagcattggagtctgtcagcctccgcttcttgcagaacacagagggcattgagcccacagtaaagcagtcgattagcaaattcatggcctttgtccacacaagtgtcaaccaaacatcccagtcttatctgagcaatgaacagcgctacaactatacaactcccaagtcctttctggagttcatcagactctaccagagcttgttgcacaggcacagaaaagagctcaagtgcaagacagagcggttggagaacgggctgctgaagctgcatagcacctctgcccaggtggatgatctgaaagcaaagctggctgcccaggaagtagagctgaagcagaaaaatgaagatgcagacaaactgattcaggtcgtgggtgtggagactgacaaagtgagcagagagaaagccatggcagatgaagaggagcagaaggtggccgtcatcatgctagaggtgaaacagaagcagaaggactgtgaggaggacctggcaaaggctgagccagcactcacagcagcgcaggcagctctcaacaccctgaacaagaccaacctgacagagctgaagtcatttggctctccgcctctggccgtcagcaatgtcagcgctgcggtgatggtactgatggctcccaggggtagggtgcccaaggaccggagctggaaggctgctaaggtcaccatggccaaagtggatggcttcctggactcgctaataaacttcaacaaagagaacattcacgagaactgcctcaaagccatcaggccgtatctgcaagaccccgagttcaatcctgagtttgtggccaccaaatcctatgcggctgcaggcctctgctcctgggtcatcaatattgtgagattttatgaggtgttctgtgatgtggaacccaagcgccaggcactgaacaaagccaccgcggacctcacagctgcccaggagaagctggctgccatcaaagccaagatcgctcaccttaatgaaaacctggcaaagctcacagccaggtttgagaaagcaacagcagacaaactcaaatgtcagcaagaagccgaagtgaccgcagtcaccatctcccttgccaaccgcctggttggaggactcgcttctgaaaacgtgaggtgggcagatgccgtgcagaacttcaaacagcaggaaaggacgttatgtggagacattttacttataacggctttcatttcctaccttggcttcttcacaaagaaataccggcagagcctcctggacagaacttggaggccctacctgagccagctgaaaactcccattccagtcaccccagccctggatcccctgaggatgctgatggatgatgctgacgtggctgcctggcagaacgagggcctcccagccgaccgcatgtccgtggagaatgccaccattctcatcaactgtgagcgctggccactcatggttgaccctcagctacaaggcatcaaatggatcaagaataaatatggtgaagatctccgggtcacgcagattggtcagaaaggctaccttcaaatcatagagcaggccctggaagctggagctgtggtgctgattgaaaatctagaggagtccattgatcctgttctgggacccctgcttgggagagaagtcattaaaaaaggacgattcattaaaattggagacaaagaatgtgaatacaatcccaagttccggctcatcctccacaccaagctggctaatcctcactaccagcctgagctgcaggctcaggccaccctgatcaacttcaccgtgaccagggatggcctggaggaccagttgctggccgctgtggtcagcatggagaggccagacttggagcagctgaagtccgatctcacaaagcagcagaatggattcaaaattaccctgaaaacgttggaagacagtcttctctctcgcctctcctccgcctctgggaacttcctgggagaaacagtgctggtggaaaacctagagatcaccaagcagactgctgccgaagttgagaaaaaggtccaggaggccaaggtgactgaagtgaaaatcaacgaggcccgagagcactaccggccagcagctgccagggcctcactgctctacttcatcatgaacgacctcagcaagatccatccaatgtaccagttttctctcaaggccttcagtatcgtcttccagaaggctgtggagagggctgctcctgacgaaagcctcagggagcgggtggccaacctaatagacagcataaccttctctgtgtaccagtacaccatccgcgggctctttgagtgtgataagctgacctaccttgcccagctcacctttcagattctcctcatgaaccgagaagtcaatgcagtggagttggatttcctgcttcgatctccagtgcagacgggcaccgccagccccgtggagttcctctcccatcaggcgtggggagctgtcaaggtactttcatcaatggaagaattctctaatctggatcgggacatagagggatctgctaagagctggaaaaagtttgtggagtccgaatgtcctgagaaagagaagctcccacaggagtggaagaacaagacagccctgcagcgcctctgcatgctgagagccatgcggcccgaccggatgacctatgctttgcgagattttgttgaagagaagttaggaagcaaatacgtggtgggaagagccctagattttgcaacctcatttgaagaatcgggaccagccactcctatgtttttcatcctgtctccaggggtggacccactgaaggatgtagaaagtcaaggaagaaaacttggatacaccttcaacaatcagaactttcacaacgtgtctttggggcaaggacaggaagtggtggctgaggctgcgctggacctcgctgccaagaaaggtcactgggttattttgcaggacactctggagatgtgttctcgggagacggagtttaagagcatcctctttgctctttgttacttccatgcggtggtggcagaaagacgaaaatttgggccccagggatggaatcgctcatacccctttaacactggagacctcactatctctgtgaatgtcctctacaacttcctggaggccaacgcaaaggtcccctatgatgatttgcgctacctgtttggagagatcatgtatggaggccatatcacagatgactgggacagaagactctgcagaacctacctgggggaattcattcgaccagaaatgttagaaggagaactgtctttggccccagggttcccactcccaggcaacatggactacaatggttatcatcagtacatcgatgctgagctgcccccagaatccccctacctctatggcctccacccgaacgcagagattggcttcctgacccaaacctcagaaaagctcttccgcactgtgctggagctgcagcctcgggacagccaggccagagacggagcgggcgccacaagagaagaaaaggtcaaggcacttctggaagaaatattggagcgggtgacagacgagtttaacatcccagaactgatggccaaagtggaggagcgcaccccttacattgtagttgccttccaggagtgtggccggatgaatatcctcaccagagagattcagcgctcactgagggagctggagctcggcttaaagggggagctgactatgaccagccacatggagaacttacagaatgccctgtacttcgatatggtgccagagtcctgggctagacgagcctacccttccacagcaggcctggcagcctggtttccagacctcctcaacagaatcaaggagctagaggcttggacgggtgactttacaatgccctccactgtgtggctgacaggcttcttcaacccccagtcgttcctgactgccatcatgcagtccacggctcgcaagaatgagtggccactggaccagatggccctgcaatgtgacatgacgaagaagaacagagaagagtttaggagtcctcctcgggaaggggcctacatccatggcctcttcatggaaggtgcctgctgggacacacaggctgggatcattacagaggcaaagctgaaggatctgacaccccctatgcctgtgatgttcatcaaggccattcctgcagataagcaggactgccgcagtgtctattcctgtcctgtgtacaagactagtcagcggggacccacctacgtgtggactttcaacctgaagactaaggaaaacccatccaagtgggttctggctggagtagccttgcttctccagatttagcatcctgcagagccaccgagaaaataaaaaagctgggcttggaggctgcctagagggacaggtgggtgaagggtcaccacagacacttagaacggtaagaaaccatgagcactcacaattctgtagaattcctctagggaacttggagaggtgtgcctaaggtgaggctgagctgaaggaatgtgggcccaggtttcttaataaaatgatttactcttcaactgtgtctggcccaggatttgagagctgctgaatcataaatgatcatgtagagaccaagagaaaca

SEQ ID NO: 9010 - DNA, 2499 bp, Homo sapiens
attctatcctgcaagggcacggggacccacaacgacggctgtccctaaagaaccgttgcgactggtaactgaagtggaagagagtccagatttcttgtgtgtggtcaaggagacggacaaactttttgtcttcagacgagggagcgttttgtaggctctccaggggttgagatgattcctgcttctgcgaaggctccccataaacagcctcataagcagagcatcagcataggcagaggaaccaggaagagagatgaagattcagggactgaagtgggagaaggcacagatgaatgggcccaatccaaagccacagttagaccccctgaccagctggagttgaccgatgcggagttaaaggaggagttcactcggattttgacagccaacaacccacacgcaccccagaacattgtcaggtacagcttcaaagaaggcacatataagcctattggctttgtgaaccaactggcagttcactacacccaggttgggaacctgatccccaaagactcagatgaaggacggcggcagcattaccgcgatgaattagtggcaggttctcaggagtctgtcaaggtgatttcagaaacaggaaacctcgaagaagacgaagagcccaaggagttagaaactgagcctgggagtcaaacagatgtgcctgcagctggggcagctgaaaaagtgactgaagaagaattgatgactcctaagcagcccaaggagagaaagctcactaaccagttcaacttcagtgagagggcctcacagacctacaacaaccctgtccgggatcgagaatgccagacggagcctcctcccaggacaaacttttcagccacagccaatcagtgggagatctatgatgcctatgtagaggaacttgagaagcaggaaaagaccaaagagaaggagaaggcaaagaccccagtggctaaaaaatcagggaagatggccatgaggaagctgacatctatggagtctcagactgatgatctcatcaaattgtcccaagctgctaagatcatggagcggatggtcaaccagaatacatatgatgacattgctcaagattttaagtactatgacgatgctgctgatgaataccgggaccaggtgggtaccctgctgccgctctggaagttccaaaatgacaaagccaagcgcctgtccgtcactgccctctgctggaatccaaagtacagggatctgtttgcagtgggatatggctcttatgacttcatgaagcagagccggggcatgctgctgctctacagcctgaagaaccccagcttccctgagtacatgttcagcagcaacagcggcgtcatgtgtctcgacatccacgtggaccacccctacctggtggcagtaggccactatgacggcaacgtggccatttacaacctcaagaagccccactcccagccctccttctgcagctcagccaagtctggcaagcactcagaccctgtgtggcaggtcaagtggcagaaggatgacatggaccaaaaccttaacttcttctctgtgtcatctgacggcaggattgtgtcttggactctcgtgaagagaaagctggttcacatagatgtcatcaagctgaaggtggaaggcagcaccacggaagttcctgaggggttgcagctgcacccagtgggttgtggcactgcctttgacttccacaaagagattgactacatgttcctagtgggcacagaggagggaaaaatctacaagtgctctaaatcctactccagccaattcctcgacacctatgacgcccacaacatgtcagtggacactgtgtcctggaacccataccacaccaaggtcttcatgtcctgcagctccgactggacagtgaagatctgggaccacaccatcaagaccccgatgttcatctatgacctgaactcagccgtgggtgatgtggcctgggcgccatactcttctactgtgttcgcagcagtcaccacagatgggaaggcccacatatttgacttagccatcaacaagtatgaggccatctgcaaccagcctgtggcggccaaaaagaacaggctcacccacgtgcagttcaatctcatccaccccatcatcattgtgggcgatgaccgtgggcacatcatcagcctcaagctctcacccaatttgcgcaagatgccaaaggaaaagaaggggcaggaggtgcagaagggtccagctgtggagattgcgaaactggacaaactgctgaacctggtgagggaagtgaaaatcaagacctgaggggctggcctcagtctctgtcccatcgcttgaatacagtactcctagggcttgaccctggtacccagcccagccttagcacccagcatgtgaccccactcctgatcaggtcccagcatcttcccttcttgttctgttccttaaggtcccagcaccttaccccaggacttggtcttcaaccaccattacccctctaactttgcacaaataaacctgtgtagaaaccca

SEQ ID NO: 9011 - DNA, 2337 bp, Homo sapiens
ggtaaccgcgtcagggagttggattctatcctgcaagggcacggggacccacaacgacggctgtccctaaagaaccgttgcgactggtaactgaagtggaagagagtccagatttcttgtgtgtggtcaaggagacggacaaactttttgtcttcagacgagggagcgttttgtaggctctccaggggttgagatgattcctgcttctgcgaaggctccccataaacagcctcataagcagagcatcagcataggcagaggaaccaggaagagagatgaagattcagggactgaagtgggagaaggcacagatgaatgggcccaatccaaagccacagttagaccccctgaccagctggagttgaccgatgcggagttaaaggaggagttcactcggattttgacagccaacaacccacacgcaccccagaacattgtcaggtacagcttcaaagaaggcacatataagcctattggctttgtgaaccaactggcagttcactacacccaggttgggaacctgatccccaaagactcagatgaaggacggcggcagcattaccgcgatgaattagtggcaggttctcaggagtctgtcaaggtgatttcagaaacaggaaacctcgaagaagacgaagagcccaaggagttagaaactgagcctgggagtcaaacagatgtgcctgcagctggggcagctgaaaaagtgactgaagaagaattgatgactcctaagcagcccaaggagagaaagctcactaaccagttcaacttcagtgagagggcctcacagacctacaacaaccctgtccgggatcgagaatgccagacggagcctcctcccaggacaaacttttcagccacagccaatcagtgggagatctatgatgcctatgtagaggaacttgagaagcaggaaaagaccaaagagaaggagaaggcaaagaccccagtggctaaaaaatcagggaagatggccatgaggaagctgacatctatggagtctcagactgatgatctcatcaaattgtcccaagctgctaagatcatggagcggatggtcaaccagaatacatatgatgacattgctcaagattttaagtactatgacgatgctgctgatgaataccgggaccaggtgggtaccctgctgccgctctggaagttccaaaatgacaaagccaagcgcctgtccgtcactgccctctgctggaatccaaagtacagggatctgtttgcagtgggatatggctcttatgacttcatgaagcagagccggggcatgctgctgctctacagcctgaagaaccccagcttccctgagtacatgttcagcagcaacagcggcgtcatgtgtctcgacatccacgtggaccacccctacctggtggcagtaggccactatgacggcaacgtggccatttacaacctcaagaagccccactcccagccctccttctgcagctcagccaagtctggcaagcactcagaccctgtgtggcaggtcaagtggcagaaggatgacatggaccaaaaccttaacttcttctctgtgtcatctgacggcaggattgtgtcttggactctcgtgaagagaaagctggttcacatagatgtcatcaagctgaaggtggaaggcagcaccacggaagttcctgaggggttgcagctgcacccagtgggttgtggcactgcctttgacttccacaaagagattgactacatgttcctagtgggcacagaggagggaaaaatctacaagtgctctaaatcctactccagccaattcctcgacacctatgacgcccacaacatgtcagtggacactgtgtcctggaacccataccacaccaaggtcttcatgtcctgcagctccgactggacagtgaagatctgggaccacaccatcaagaccccgatgttcatctatgacctgaactcagccgtgggtgatgtggcctgggcgccatactcttctactgtgttcgcagcagtcaccacagatgggaaggaaaagaaggggcaggaggtgcagaagggtccagctgtggagattgcgaaactggacaaactgctgaacctggtgagggaagtgaaaatcaagacctgaggggctggcctcagtctctgtcccatcgcttgaatacagtactcctagggcttgaccctggtacccagcccagccttagcacccagcatgtgaccccactcctgatcaggtcccagcatcttcccttcttgttctgttccttaaggtcccagcaccttaccccaggacttggtcttcaaccaccattacccctctaactttgcacaaataaacctgtgtagaaaccc

SEQ ID NO: 9012 - DNA, 2487 bp, Homo sapiens
ggtaaccgcgtcagggagttggattctatcctgcaagggcacggggacccacaacgacggctgtccctaaagaaccgttgcgactggtaactgaagtggaagagagtccagatttcttgtgtgtggtcaaggagacggacaaactttttgtcttcagacgagggagcgttttgtaggctctccaggggttgagatgattcctgcttctgcgaaggctccccataaacagcctcataagcaggatgaagattcagggactgaagtgggagaaggcacagatgaatgggcccaatccaaagccacagttagaccccctgaccagctggagttgaccgatgcggagttaaaggaggagttcactcggattttgacagccaacaacccacacgcaccccagaacattgtcaggtacagcttcaaagaaggcacatataagcctattggctttgtgaaccaactggcagttcactacacccaggttgggaacctgatccccaaagactcagatgaaggacggcggcagcattaccgcgatgaattagtggcaggttctcaggagtctgtcaaggtgatttcagaaacaggaaacctcgaagaagacgaagagcccaaggagttagaaactgagcctgggagtcaaacagatgtgcctgcagctggggcagctgaaaaagtgactgaagaagaattgatgactcctaagcagcccaaggagagaaagctcactaaccagttcaacttcagtgagagggcctcacagacctacaacaaccctgtccgggatcgagaatgccagacggagcctcctcccaggacaaacttttcagccacagccaatcagtgggagatctatgatgcctatgtagaggaacttgagaagcaggaaaagaccaaagagaaggagaaggcaaagaccccagtggctaaaaaatcagggaagatggccatgaggaagctgacatctatggagtctcagactgatgatctcatcaaattgtcccaagctgctaagatcatggagcggatggtcaaccagaatacatatgatgacattgctcaagattttaagtactatgacgatgctgctgatgaataccgggaccaggtgggtaccctgctgccgctctggaagttccaaaatgacaaagccaagcgcctgtccgtcactgccctctgctggaatccaaagtacagggatctgtttgcagtgggatatggctcttatgacttcatgaagcagagccggggcatgctgctgctctacagcctgaagaaccccagcttccctgagtacatgttcagcagcaacagcggcgtcatgtgtctcgacatccacgtggaccacccctacctggtggcagtaggccactatgacggcaacgtggccatttacaacctcaagaagccccactcccagccctccttctgcagctcagccaagtctggcaagcactcagaccctgtgtggcaggtcaagtggcagaaggatgacatggaccaaaaccttaacttcttctctgtgtcatctgacggcaggattgtgtcttggactctcgtgaagagaaagctggttcacatagatgtcatcaagctgaaggtggaaggcagcaccacggaagttcctgaggggttgcagctgcacccagtgggttgtggcactgcctttgacttccacaaagagattgactacatgttcctagtgggcacagaggagggaaaaatctacaagtgctctaaatcctactccagccaattcctcgacacctatgacgcccacaacatgtcagtggacactgtgtcctggaacccataccacaccaaggtcttcatgtcctgcagctccgactggacagtgaagatctgggaccacaccatcaagaccccgatgttcatctatgacctgaactcagccgtgggtgatgtggcctgggcgccatactcttctactgtgttcgcagcagtcaccacagatgggaaggcccacatatttgacttagccatcaacaagtatgaggccatctgcaaccagcctgtggcggccaaaaagaacaggctcacccacgtgcagttcaatctcatccaccccatcatcattgtgggcgatgaccgtgggcacatcatcagcctcaagctctcacccaatttgcgcaagatgccaaaggaaaagaaggggcaggaggtgcagaagggtccagctgtggagattgcgaaactggacaaactgctgaacctggtgagggaagtgaaaatcaagacctgaggggctggcctcagtctctgtcccatcgcttgaatacagtactcctagggcttgaccctggtacccagcccagccttagcacccagcatgtgaccccactcctgatcaggtcccagcatcttcccttcttgttctgttccttaaggtcccagcaccttaccccaggacttggtcttcaaccaccattacccctctaactttgcacaaataaacctgtgtagaaaccc

SEQ ID NO: 9013 - DNA, 1039 bp, Homo sapiens
attctatcctgcaagggcacggggacccacaacgacggctgtccctaaagaaccgttgcgactggtaactgaagtggaagagagtccagatttcttgtgtgtggtcaaggagacggacaaactttttgtcttcagacgagggagcgttttgtaggctctccaggggttgagatgattcctgcttctgcgaaggctccccataaacagcctcataagcaggatgaagattcagggactgaagtgggagaaggcacagatgaatgggcccaatccaaagccacagttagaccccctgaccagctggagttgaccgatgcggagttaaaggaggagttcactcggattttgacagccaacaacccacacgcaccccagaacattgtcaggtacagcttcaaagaaggcacatataagcctattggctttgtgaaccaactggcagttcactacacccaggttgggaacctgatccccaaagactcagatgaaggacggcggcagcattaccgcgatgaattagtggcaggttctcaggagtctgtcaaggtgatttcagaaacaggaaacctcgaagaagacgaagagcccaaggagttagaaactgagcctgggagtcaaacagatgtgcctgcagctggggcagctgaaaaagtgactgaagaagaattgatgactcctaagcagcccaaggagagaaagctcactaaccagttcaacttcagtgagagggcctcacagacctacaacaaccctgtccgggatcgagaatgccagacggagcctcctcccaggacaaacttttcagccacagccaatcagtgggagatctatgatgcctatgtagaggaacttgagaagcaggaaaagaccaaagagaaggagaaggcaaagaccccagtggctaaaaaatcagggaagatggccatgaggaagctgacatctatggagtctcagactgatgatctcatcaaattgtcccaagctgctaagatcatggagcggatggtcaaccagaatacatatgatgacattgctcaag

SEQ ID NO: 9014 - DNA, 656 bp, Homo sapiens
gttgtggcactgcctttgacttccacaaagagattgactacatgttcctagtgggcacagaggagggaaaaatctacaagtgctctaaatcctactccagccaattcctcgacacctatgacgcccacaacatgtcagtggacactgtgtcctggaacccataccacaccaaggtcttcatgtcctgcagctccgactggacagtgaagatctgggaccacaccatcaagaccccgatgttcatctatgacctgaactcagccgtgggtgatgtggcctgggcgccatactcttctactgtgttcgcagcagtcaccacagatgggaaggaaaagaaggggcaggaggtgcagaagggtccagctgtggagattgcgaaactggacaaactgctgaacctggtgagggaagtgaaaatcaagacctgaggggctggcctcagtctctgtcccatcgcttgaatacagtactcctagggcttgaccctggtacccagcccagccttagcacccagcatgtgaccccactcctgatcaggtcccagcatcttcccttcttgttctgttccttaaggtcccagcaccttaccccaggacttggtcttcaaccaccattacccctctaactttgcacaaataaacctgtgtagaaaccca

SEQ ID NO: 9015 - DNA, 1325 bp, Homo sapiens
gttgcgactggtaactgaagtggaagagagtccagatttcttgtgtgtggtcaaggagacggacaaactttttgtcttcagacgagggagcgttttgtaggctctccaggggttgagatgattcctgcttctgcgaaggctccccataaacagcctcataagcagagcatcagcataggcagaggaaccaggaagagagatgaagattcagggactgaagtgggagaaggcacagatgaatgggcccaatccaaagccacagttagaccccctgaccagctggagttgaccgatgcggagttaaaggaggagttcactcggattttgacagccaacaacccacacgcaccccagaacattgtcaggtacagcttcaaaaagcaatggagtctgggtttcattcctaaactgaagaggaagatcccagtcaactactggggacaagatgaaggtgaaatctcaaatgaaactgtaagggtaatttattccttgggaatcttcatcatgaaaatagttactattttattgaacattaatattgagcatttattatgtgtcagacactgtgttaataggttgtttttattatttttaatacttataattatcatgcaaattagatagtattagccttcttttatagatgaagaacttagggcttagagtggttaagcccaaagtcatgaagataagaagcagcagaataaagattcaaacccaactctgcctgcctccaaagaccatgctcttaaccactgcactgacttgtcttcccatacatctgagttactgaaagaagaagggctctgtggtgacttttaaatacagagcttcccaacctgtgtgatggcgatccttccagccctccaggggcagggagatctgtgcaactggaccccatgaactggtttcctctactgtgagtttaccgtagtgtgccatacaaacatagtttctatatggcttgaaaagggtttgcatatctgttttaaaagaaggaagagatctccggtctctaagtcaattttagtggttgcaagggtgctgatcaatgaggaggctatctgcaggaaccagactacaagctctgtgaaataagggattgtgtctactttttctcagctttatatcccaggcacctggaaaatacttggcacattgaggctgttcaaaaattatttcaagaatggatgaacaaaatgacctgggctgtaagcctaatcctgcttctcatttgctgtgtgacccggacaaatgccaacccatatcttttctggaattccatggtcctcttgtatggaactaggggattggggttgtctctg

SEQ ID NO: 9016 - DNA, 1992 bp, Homo sapiens
ggtaaacgccgccgtttgaggagcaccggagccgcgaccgtggattgaacgcttccccagagacccagaagcagaaggagcggacccaggcagccggcaccatggagattgtgtacgtgtacgtcaagaagcgcagcgagttcgggaagcagtgcaatttctcggaccgccaggccgagctgaacatcgacatcatgcccaaccctgagctggccgagcagttcgtggagcggaacccagtggacacgggcatccagtgctcgatcagcatgtcggaacacgaggccaactcagagcggtttgagatggagacccggggagttaaccatgtcgaggggggctggcccaaggacgtgaaccccctggagctggagcagaccatccgtttccggaagaaagtggagaaagatgagaactacgttaacgccatcatgcagctcggctctggacccccaggaaatcaagagggctgccacacacctctcctggcaccccgatggcaacaggaagttggcagtggcatactcctgcttggattttcagcgggcacctgtgggcatgagcagcgattcatacatctgggacctggaaaaccccaacaagcctgaacttgctctgaagccatcgtctccactcgtgacgttggagttcaaccccaaagattcccacgtactcctgggtggctgctacaatggacagatagcctgctgggacacccgaaagggcagcctggtggcggagctatccaccattgagtccagccaccgagaccctgtgtatggcaccatctggctgcagtcgaagacgggcaccgagtgcttctcagcttccacggatgggcaggtcatgtggtgggacatccgaaagatgagcgagcccactgaagttgtgatcttggacatcaccaagaaggaacagttggaaaatgccttgggggccatctccctggagttcgaatctactttgcccaccaagttcatggtggggaccgagcagggcatcgtcatctcctgcaaccgcaaggccaagacgtcagctgaaaagattgtgtgcaccttcccgggccatcatggccccatctacgccctccagagaaaccccttctacccgaagaacttcctgacggttggcgactggacagcccgcatttggtctgaagacagccgggaatcgtccatcatgtggaccaagtaccacatggcttacctcactgatgctgcctggagccccgtgaggccgaccgttttctttaccaccaggatggacggaaccctggatatctgggacttcatgttcgagcagtgcgatcccaccctcagcttgaaggtgtgtgacgaggccctcttctgcctccgggtgcaggacaatgggtgtctcatcgcctgcggctcccagctggggacaaccaccctgctggaggtctcgcctgggctctctaccctccagaggaatgagaagaacgtagcctcttccatgtttgagcgtgagacccggcgagagaagatcctggaggccaggcaccgggagatgcggctgaaggagaaggcagcaaccaagtccagaagaagaccaggtggtggaggagggagaggaagcagcgggggaagaaggggatgaagaagtggaagaagacttagcctagaagtcagccttcgactgcggcgctatccctgtgtgccttcctttcccacctcttgaccctcaaccagacttgcatggccatggcagggcctcgggaagaccttcaggagtggggaagggtttctcctccatgatcgaccctcctcgtccacctacaaatcaggaacagaaagtctgtccactttgaaaatacctttccaggcagctccctgaccatttggacacattgccacgacaggagcctccaagtatgtgggaggggacgggcgggacgagcttggctgttctgctgcacctgaatgctttctgttatcctaattcttgtaaaattaaatgaatcgtaacaatgcc

SEQ ID NO: 9017 - DNA, 2278 bp, Homo sapiens
caagcaaccggtaaacgccgccgtttgaggagcaccggagccgcgaccgtggattgaacgcttccccagagacccagaagcagaaggagcggacccaggcagccggcaccatggagattgtgtacgtgtacgtcaagaagcgcagcgagttcgggaagcagtgcaatttctcggaccgccaggccgagctgaacatcgacatcatgcccaaccctgagctggccgagcagttcgtggagcggaacccagtggacacgggcatccagtgctcgatcagcatgtcggaacacgaggccaactcagagcggtttgagatggagacccggggagttaaccatgtcgaggggggctggcccaaggacgtgaaccccctggagctggagcagaccatccgtttccggaagaaagtggagaaagatgagaactacgttaacgccatcatgcagctcggctctatcatggagcactgcatcaagcagaacaatgccattgacatctatgaagagtatttcaatgacgaggaggccatggaagtgatggaggaggacccttcagctaaaaccatcaatgtgttcagggacccccaggaaatcaagagggctgccacacacctctcctggcaccccgatggcaacaggaagttggcagtggcatactcctgcttggattttcagcgggcacctgtgggcatgagcagcgattcatacatctgggacctggaaaaccccaacaagcctgaacttgctctgaagccatcgtctccactcgtgacgttggagttcaaccccaaagattcccacgtactcctgggtggctgctacaatggacagatagcctgctgggacacccgaaagggcagcctggtggcggagctatccaccattgagtccagccaccgagaccctgtgtatggcaccatctggctgcagtcgaagacgggcaccgagtgcttctcagcttccacggatgggcaggtcatgtggtgggacatccgaaagatgagcgagcccactgaagttgtgatcttggacatcaccaagaaggaacagttggaaaatgccttgggggccatctccctggagttcgaatctactttgcccaccaagttcatggtggggaccgagcagggcatcgtcatctcctgcaaccgcaaggccaagacgtcagctgaaaagattgtgtgcaccttcccgggccatcatggccccatctacgccctccagagaaaccccttctacccgaagaacttcctgacggttggcgactggacagcccgcatttggtctgaagacagccgggaatcgtccatcatgtggaccaagtaccacatggcttacctcactgatgctgcctggagccccgtgaggccgaccgttttctttaccaccaggatggacggaaccctggatatctgggacttcatgttcgagcagtgcgatcccaccctcagcttgaaggtgtgtgacgaggccctcttctgcctccgggtgcaggacaatgggtgtctcatcgcctgcggctcccagctggggacaaccaccctgctggaggtctcgcctgggctctctaccctccagaggaatgagaagaacgtagcctcttccatgtttgagcgtgagacccggcgagagaagatcctggaggccaggcaccgggagatgcggctgaaggagaagggtaaggcggagggcagggatgaggagcagaccgatgaggagctggccgtagacctggaggcgctggtcagcaaggccgaggaggagttcttcgacatcatcttcgcagagctgaagaagaaggaggcagacgccataaagctgacgccagtgcctcagcaaccaagtccagaagaagaccaggtggtggaggagggagaggaagcagcgggggaagaaggggatgaagaagtggaagaagacttagcctagaagtcagccttcgactgcggcgctatccctgtgtgccttcctttcccacctcttgaccctcaaccagacttgcatggccatggcagggcctcgggaagaccttcaggagtggggaagggtttctcctccatgatcgaccctcctcgtccacctacaaatcaggaacagaaagtctgtccactttgaaaatacctttccaggcagctccctgaccatttggacacattgccacgacaggagcctccaagtatgtgggaggggacgggcgggacgagcttggctgttctgctgcacctgaatgctttctgttatcctaattcttgtaaaattaaatgaatcgtaacaatgcc

SEQ ID NO: 9018 - DNA, 2474 bp, Homo sapiens
cctcccaatgtgctgggattacagttgtcagctaccgcgcctggccaaaatttttattgccctcctcagagagcaactgcaataactaaacagggtaatgcttagcatatagtcggcactcaggatttttttttaatgcggatgcagcttctggacaaattcctaggatctccccaccaccccttgcttcctgccccaaccagattgagaacctggagctgtcctggcaggacctgtggagatagggaaggggccggtggggtccctcaccccacaccctccctctgccccccagcagccggcaccatggagattgtgtacgtgtacgtcaagaagcgcagcgagttcgggaagcagtgcaatttctcggaccgccaggccgagctgaacatcgacatcatgcccaaccctgagctggccgagcagttcgtggagcggaacccagtggacacgggcatccagtgctcgatcagcatgtcggaacacgaggccaactcagagcggtttgagatggagacccggggagttaaccatgtcgaggggggctggcccaaggacgtgaaccccctggagctggagcagaccatccgtttccggaagaaagtggagaaagatgagaactacgttaacgccatcatgcagctcggctctatcatggagcactgcatcaagcagaacaatgccattgacatctatgaagagtatttcaatgacgaggaggccatggaagtgatggaggaggacccttcagctaaaaccatcaatgtgttcagggacccccaggaaatcaagagggctgccacacacctctcctggcaccccgatggcaacaggaagttggcagtggcatactcctgcttggattttcagcgggcacctgtgggcatgagcagcgattcatacatctgggacctggaaaaccccaacaagcctgaacttgctctgaagccatcgtctccactcgtgacgttggagttcaaccccaaagattcccacgtactcctgggtggctgctacaatggacagatagcctgctgggacacccgaaagggcagcctggtggcggagctatccaccattgagtccagccaccgagaccctgtgtatggcaccatctggctgcagtcgaagacgggcaccgagtgcttctcagcttccacggatgggcaggtcatgtggtgggacatccgaaagatgagcgagcccactgaagttgtgatcttggacatcaccaagaaggaacagttggaaaatgccttgggggccatctccctggagttcgaatctactttgcccaccaagttcatggtggggaccgagcagggcatcgtcatctcctgcaaccgcaaggccaagacgtcagctgaaaagattgtgtgcaccttcccgggccatcatggccccatctacgccctccagagaaaccccttctacccgaagaacttcctgacggttggcgactggacagcccgcatttggtctgaagacagccgggaatcgtccatcatgtggaccaagtaccacatggcttacctcactgatgctgcctggagccccgtgaggccgaccgttttctttaccaccaggatggacggaaccctggatatctgggacttcatgttcgagcagtgcgatcccaccctcagcttgaaggtgtgtgacgaggccctcttctgcctccgggtgcaggacaatgggtgtctcatcgcctgcggctcccagctggggacaaccaccctgctggaggtctcgcctgggctctctaccctccagaggaatgagaagaacgtagcctcttccatgtttgagcgtgagacccggcgagagaagatcctggaggccaggcaccgggagatgcggctgaaggagaagggtaaggcggagggcagggatgaggagcagaccgatgaggagctggccgtagacctggaggcgctggtcagcaaggccgaggaggagttcttcgacatcatcttcgcagagctgaagaagaaggaggcagacgccataaagctgacgccagtgcctcagcaaccaagtccagaagaagaccaggtggtggaggagggagaggaagcagcgggggaagaaggggatgaagaagtggaagaagacttagcctagaagtcagccttcgactgcggcgctatccctgtgtgccttcctttcccacctcttgaccctcaaccagacttgcatggccatggcagggcctcgggaagaccttcaggagtggggaagggtttctcctccatgatcgaccctcctcgtccacctacaaatcaggaacagaaagtctgtccactttgaaaatacctttccaggcagctccctgaccatttggacacattgccacgacaggagcctccaagtatgtgggaggggacgggcgggacgagcttggctgttctgctgcacctgaatgctttctgttatcctaattcttgtaaaattaaatgaatcgtaacaatgcc

SEQ ID NO: 9019 - DNA, 2312 bp, Homo sapiens
aaccagagcagtgacagtagcaaccgccggaatggcgaaagcaacaacaatcaaagaagccttagcgagatgggaagctttcactgtctacaaactgcattgaaaaaattgccaacctgaatggcttaaaaaacttgaggatattatctttaggaagaaacaacataaagaacttaaatggactggaggcagtaggggacacattagaagaactgtggatctcctacaattttattgagaagttgaaagggatccacataatgaagaaattgaagattctctacatgtctaataacctggtaaaagactgggctgagtttgtgaagctggcagaactgccatgcctcgaagacctggtgtttgtaggcaatcccttggaagagaaacattctgctgagaataactggattgaagaagcaaccaagagagtgcccaaactgaaaaagctggatggtactccagtaattaaaggggatgaggaagaagacaactaatgccacgctttccactgtgtgttaacttatttaaatgtcataagaacaatagataaattttatataattgtctattttaaagattctgtatgggacaaaagtttcttaagataaaacagatcactcattctcatctttttttttcctttaacttattcagtgtttctccccaaaactggtaatgccaaccttatatatcctatttctctttttagaaaccacaaattttcgatttttgtcttcagtctcagttacgtactgtgtagccccatctactaaaacaaaacctttgtagaccagtcatttttaataacaaaggaacaaatgtttttttcagtttgttcattttttttaggttagacattttaaaagatgtacatttgaaaattcagaacatttttcctgaaggtctgtctctgtacaattcagaagcacatgcctttagctcagaaggcagcatggtgatgggaagagttcctcttagaaatacagcaggtccggaaccaagactccaaagttccattggaaaagatatggtgaaaaaaggaaaaagtagtatctcagagaccttctagtctatattatacttatttgtttttccaaaaatgtgcacattgtcaactggaatttaggttgtttttatatgcatggccacttgagtcattgtgtacagtcattctgtgatctcagttagtggttaaaatgactgtcatgatcatttctttgactgataatgtggcaatgttactcatgtggacctcgccttaagcacacattttggttttatagttccttatgtgtttaaagcattagttatatttgaattcctagactaaatgctggccattgatgtatgtcaaaatttaccctaattatttggtctggtgaccctcattgttgggaaaagtgactaccatggttataagtaagggtataatgaaacttagtatttcaaaatatattttttgagaagttctaagttaaacagctcttaaaatgtattatgtacgtggttgtggagggaagggagatgtttcattatgagatcccaggcaaatggcaatatgtttgaggattgtctcctacataaagcagtgtaggtgatttaacctcaaaattgcaaagcaatagttagatgcagaggttagaatttatcatgtaaacaaaaaatccttcaggaaaatgtaagacattgtagtcagtaagcagatgaggtcataggaggccatggctggatcactattagattgcagaaaagaagtcaggggccctctgccaaattgtgcctaaagtccctcagagactgttgattctggtttccccatctacttgtgtgattttacttgcataaaatcacagtgaaagagggaagaatcatctttaaaaagtgattgcataagtagtcctgggtttcagaagatttcagctatcatttacataggaattacttgatttttctaagttactctgatcaaaagggaccactgctttgacaatcaactctaaatacaaacaagaggccaggcgtggtggctcatgcctgtcatcccagcactttgggaggccgaggcgggcggatcatctgagatcaggagttcaagaccagcctgaccaacatggtgaaaccccgtctctactaaaaatacaaaaattagccagtcctggtggtgggcgcctgtagtcccaactactcgggaggctgaggcaggagaatcatttgaacccgggaggcggaggttgcagtgagccgagattgcgccattgcactccagcctgggcaatagagcgagactccatatttaaaaaaaaaaaaaaaaa

SEQ ID NO: 9020 - DNA, 617 bp, Homo sapiens
gctgggccttgattggttgagtcaagtgagctgattggttgattcaggcgaaagcaacaacaatcaaagaagccttagcgagatgggaagagaaaactggccagaggccatctgaagccaaagagataaaactttatgcccagattccccctatagagaagatggatgcatccttgtccatgcttgctaattgcgagaagctttcactgtctacaaactgcattgaaaaaattgccaacctgaatggcttaaaaaacttgaggatattatctttaggaagaaacaacataaagaacttaaatggactggaggcagtaggggacacattagaagaactgtggatctcctacaattttattgagaagttgaaagggatccacataatgaagaaattgaagattctctacatgtctaataacctggtaaaagactgggctgagtttgtgaagctggcagaactgccatgcctcgaagacctggtgtttgtaggcaatcccttggaagagaaacattctgctgagaataactggattgaagaagcaaccaagagagtgcccaaactgaaaaagctggatggtactccagtaattaaaggggatgaggaagaagacaactaa

SEQ ID NO: 9021 - DNA, 1166 bp, Homo sapiens
gggccctagcaaccagagcagtgacagtagcaaccgccggaatggcgaaagcaacaacaatcaaagaagccttagcgagatgggaagagaaaactggccagaggccatctgaagccaaagagataaaactttatgcccagattccccctatagagaagatggatgcatccttgtccatgcttgctaattgcgagaagctttcactgtctacaaactgcattgaaaaaattgccaacctgaatggcttaaaaaacttgaggatattatctttaggaagaaacaacataaagaacttaaatggactggaggcagtaggggacacattagaagaactgtggatctcctacaattttattgagaagttgaaagggatccacataatgaagaaattgaagattctctacatgtctaataacctggtaaaagactgggctgagtttgtgaagctggcagaactgccatgcctcgaagacctggtgtttgtaggcaatcccttggaagagaaacattctgctgagaataactggattgaagaagcaaccaagagagtgcccaaactgaaaaagctggatggtactccagtaattaaaggggatgaggaagaagacaactaatgccacgctttccactgtgtgttaacttatttaaatgtcataagaacaatagataaattttatataattgtctattttaaagattctgtatgggacaaaagtttcttaagataaaacagatcactcattctcatctttttttttcctttaacttattcagtgtttctccccaaaactggtaatgccaaccttatatatcctatttctctttttagaaaccacaaattttcgatttttgtcttcagtctcagttacgtactgtgtagccccatctactaaaacaaaacctttgtagaccagtcatttttaataacaaaggaacaaatgtttttttcagtttgttcattttttttaggttagacattttaaaagatgtacatttgaaaattcagaacatttttcctgaaggtctgtctctgtacaattcagaagcacatgcctttagctcagaaggcagcatggtgatgggaagagttcctcttagaaatacagcaggtccggaaccaagactccaaagttccattggaaaagatatggtgaaaaaaggaaaaa

SEQ ID NO: 9022 - DNA, 526 bp, Homo sapiens
gcggccgccacgcagtcccacaatgccccgctcgcaccaccctgagggcggagagaaaggaccgctgccggggatagggcttccgccgagagcgccgagaagtgcgcacgcgcactgaccccgcgggccctagcaaccagagcagtgacagtagcaaccgccggaatggaagctttcactgtctacaaactgcattgaaaaaattgccaacctgaatggcttaaaaaacttgaggatattatctttaggaagaaacaacataaagaacttaaatggactggaggcagtaggggacacattagaagaactgtggatctcctacaattttattgagaagttgaaagggatccacataatgaagaaattgaagattctctacatgtctaataacctggtaaaagactgggctgagtttgtgaagctggcagaactgccatgcctcgaagacctggtgtttgtaggcaatcccttggaagagaaacattctgctgagaataactggattgaagaagcaaccaagagagtg

SEQ ID NO: 9023 - DNA, 632 bp, Homo sapiens
agcaaccgccggaatgctgggccttgattggttgagtcaagtgagctgattggttgattcaggcgaaagcaacaacaatcaaagaagccttagcgagatgggaagagaaaactggccagaggccatctgaagccaaagagataaaactttatgcccagattccccctatagagaagatggatgcatccttgtccatgcttgctaattgcgagaagctttcactgtctacaaactgcattgaaaaaattgccaacctgaatggcttaaaaaacttgaggatattatctttaggaagaaacaacataaagaacttaaatggactggaggcagtaggggacacattagaagaactgtggatctcctacaattttattgagaagttgaaagggatccacataatgaagaaattgaagattctctacatgtctaataacctggtaaaagactgggctgagtttgtgaagctggcagaactgccatgcctcgaagacctggtgtttgtaggcaatcccttggaagagaaacattctgctgagaataactggattgaagaagcaaccaagagagtgcccaaactgaaaaagctggatggtactccagtaattaaaggggatgaggaagaagacaactaa

SEQ ID NO: 9024 - DNA, 623 bp, Homo sapiens
gaccccgcgggccctagcaaccagagcagtgacagtagcaaccgccggaatgctgggccttgattggttgagtcaagtgagctgattggttgattcaggcgaaagcaacaacaatcaaagaagccttagcgagatgggaagagaaaactggccagaggccatctgaagccaaagagataaaactttatgcccagattccccctatagagaagatggatgcatccttgtccatgcttgctaattgcgactttcactgtctacaaactgcattgaaaaaattgccaacctgaatggcttaaaaaacttgaggatattatctttaggaagaaacaacataaagaacttaaatggactggaggcagtaggggacacattagaagaactgtggatctcctacaattttattgagaagttgaaagggatccacataatgaagaaattgaagattctctacatgtctaataacctggtaaaagactgggctgagtttgtgaagctggcagaactgccatgcctcgaagacctggtgtttgtaggcaatcccttggaagagaaacattctgctgagaataactggattgaagaagcaaccaagagagtgcccaaactgaaaaagctggatg

SEQ ID NO: 9025 - DNA, 502 bp, Homo sapiens
cagtgacagtagcaaccgccggaatgatggggtcttgctgtgttgtccaggctggtctcaaactcctggcctcaagtgatcctccagccttggcttcccatagtgctgggattgcaggcatgagccaccatgtccagcttgaagatataatattgtatctaggattttcaaatccatgttgaaaactgggccttgattggttgagtcaagtgagctgattggttgattcaggcgaaagcaacaacaatcaaagaagccttagcgagatgggaagagaaaactggccagaggccatctgaagccaaagagataaaactttatgcccagattccccctatagagaagatggatgcatccttgtccatgcttgctaattgcgagaagctttcactgtctacaaactgcattgaaaaaattgccaacctgaatggcttaaaaaacttgaggatattatctttaggaagaaacaacataaagaacttaaatggactggaggcagtag

SEQ ID NO: 9026 - DNA, 639 bp, Homo sapiens
gaagagaaaactggccagaggccatctgaagccaaagagataaaactttatgcccagattccccctatagagaagatggatgcatccttgtccatgcttgctaattgcgagaagctttcactgtctacaaactgcattgaaaaaattgccaacctgaatggcttaaaaaacttgaggatattatctttaggaagaaacaacataaagaacttaaatggactgagatggggtttcaccgtagtagccaggatggtctcgatctcctgacctcatgatccgcctgcctcggcctcccaaagtgctgggattacaggcgtgagccaccacacctgggcaaaatttgatatttgtgatgttctaaataaattggaggcagtaggggacacattagaagaactgtggatctcctacaattttattgagaagttgaaagggatccacataatgaagaaattgaagattctctacatgtctaataacctggtaaaagactgggctgagtttgtgaagctggcagaactgccatgcctcgaagacctggtgtttgtaggcaatcccttggaagagaaacattctgctgagaataactggattgaagaagcaaccaagagagtgcccaaactgaaaaagctggatggt

SEQ ID NO: 9027 - DNA, 2649 bp, Homo sapiens
ggcggtttccatggtgacggcaaacaaggcccacactggacagggcagctgctgggttgctactctcgcctccgccatgattccgcccgcagactctttgctcaagtacgacaccccagtgctggtgagccggaacacggagaaacggagccccaaggctcggctactgaaagtcagcccccagcagcctggaccttcaggttcagccccacagccacccaagaccaagctcccctcaactccctgtgtcccagatcctacaaagcaggcagaagaaatcttgaatgccatactacccccaagggagtgggtggaagacacgcagctatggatccagcaggtgtccagcacccctagcaccaggatggacgtggtgcacctccaggagcagttagacttaaagctgcagcagcggcaggccagggaaacaggcatctgccctgtccgcagggaactctactcacagtgttttgatgagttgatccgggaggtcaccatcaactgtgcggagagggggctgctgctgctgcgagtccgggacgagatccgcatgaccatcgctgcctaccagaccctgtacgagagcagcgtggcgtttggcatgaggaaggcactgcaggctgagcaggggaagtcagacatggagaggaaaatcgcagaattggagacggaaaagagagacctggagaggcaagtgaacgagcagaaggcaaaatgtgaagccactgagaagcgggagagcgagaggcggcaggtggaggagaagaagcacaatgaggagattcagttcctgaagcgaacaaatcagcagctgaaggcccaactggaaggcattattgcaccaaagaagtgataatttccacatgattaatttccaacaagacacttgggagttatttactgtgttcctctggcagccaataaaatcatcataagccctttgtaataaaaagctagtttcctgagtgaacaagccataacctcccctaaacaccacctaggtatttgttagaagtcacactattactccaatgtcatcagacacctaaggtctgccagccaggctcctggctgggcaatggaagatggtgtggccctgttagtctccgtgtgtggcttactagccagccttgggaactgccaactcaaattctaagaaagccactgctttctcatcatcactctataccaatacttatttctggccaaatgaatctgcttctctgcccctcaaacttttagttcacaattcatcttctaccttaacttgggcttcttgggcctctggccttccttacttaatgtcttcttttccctactctaatgcatttctaactcactttggagctttggttttctaatgtattatccccacttgccagtcaactggaccccttcctcctcggtttcagactgcctacattaggaaacaatggcagtcaaacccatggctttggagaaagtaaatgtttgccagaaaggaatactagtcacagtggcctttgtgagttgtctgcaactcagctcttcccccagcacagatctgttccccttatcctgcagaaaatcaagccctgactctgcactccccgaagtagtgatgttaattaacaactgaagaggtaactaaatctcacatgcaggtctaatgactaataattggagtacggctgctagacaactgcattttagtatttctcttccattctcctggttttgtagacccagaagattgaatgagtgacataaatctttagttcggggcaagccagggtgggctagggtggtaagctggaggacttcatccttcagttaggctgcacaagtaacattacctaaaaggcactaacatgctcaggttccccagaaagaggcgtaagaagggcctctccttagcagagcttccacctgccatccgtcttgggttcagtgagcttcaaggctcacaatggaagcactgtcatttccccagaaaagctgtgttccctatgctgaacacaccatacacattctcatctggaatctaaggagcagcttttaccctgatccagtatcctgaggaattttaagcctccactcaaatgacctgcctgtgttgtcatttccatgggaaagaactctttccacgagatctgctagttccaggcctctaagacaggaacgtatgtgccataagtgggtctacttcacagactcaatgaggcagaaattattgtagttttctcctatttcttctgcacccaactttctccttgtatttcaaaggccaggccatgtacactaacgtccttgaaatttgcagttctgtatgcttctattccaaatcattcattaccaataaaaacgaaataccaccctttccattttatagacctcatcccctatttctgtcagacagttatatgacagggtgactgtggaacctcttagttcatccaaagtctacctgaagtgctagactttcagactcttatcactgaaatccttaaggttgaggaggctttatttccctagcactggtgaagggcttcaactgtcaaacctcagaacaaatgcattagggccttagaaatgtcaatggggcaggaagaaaacacaatttctaactgcctgtttttgtataatttaataaaaaccttttaaacatta

SEQ ID NO: 9028 - DNA, 1168 bp, Homo sapiens
cgcagactctttgctcaagtacgacaccccagtgctggtgagccggaacacggagaaacggagccccaaggctcggctactgaaagtcagcccccagcagcctggaccttcaggttcagccccacagccacccaagaccaagctcccctcaactccctgtgtcccagatcctacaaagcaggcagaagaaatcttgaatgccatactacccccaagatgagttgatccgggaggtcaccatcaactgtgcggagagggggctgctgctgctgcgagtccgggacgagatccgcatgaccatcgctgcctaccagaccctgtacgagagcagcgtggcgtttggcatgaggaaggcactgcaggctgagcaggggaagtcagacatggagaggaaaatcgcagaattggagacggaaaagagagacctggagaggcaagtgaacgagcagaaggcaaaatgtgaagccactgagaagcgggagagcgagaggcggcaggtggaggagaagaagcacaatgaggagattcagttcctgaagcgaacaaatcagcagctgaaggcccaactggaaggcattattgcaccaaagaagtgataatttccacatgattaatttccaacaagacacttgggagttatttactgtgttcctctggcagccaataaaatcatcataagccctttgtaataaaaagctagtttcctgagtgaacaagccataacctcccctaaacaccacctaggtatttgttagaagtcacactattactccaatgtcatcagacacctaaggtctgccagccaggctcctggctgggcaatggaagatggtgtggccctgttagtctccgtgtgtggcttactagccagccttgggaactgccaactcaaattctaagaaagccactgctttctcatcatcactctataccaatacttatttctggccaaatgaatctgcttctctgcccctcaaacttttagttcacaattcatcttctaccttaacttgggcttcttgggcctctggccttccttacttaatgtcttcttttccctactctaatgcatttctaactcactttggagctttggttttctaatgtattatccccacttgccagtcaactggaccccttcctcctcggtttcagactgcctacatta

SEQ ID NO: 9029 - DNA, 14333 bp, Homo sapiens
ctggcagtggctgcctttagggcggagccggctcccgctctcctcagtctgcggtgggctagcggacggtccggcttccggcggccgtttctgtctcttgctggctgtctcgctgagtcgcggccgccttctcatcgctcctggaaggtcccgagcgcgacaccatgtcggagcccgggggcggcggcggcgaggacggctcggccggattggaagtgtcggccgtgcagaatgtggcggacgtgtcggtgctgcagaagcacctgcgcaagctggtgccgctgctgctggaggacggcggcgaggcgccggccgcgctggaggcggcgctggaggagaagagcgccctggagcagatgcgcaagttcctttcggacccgcaggtccacacggtgctggtggagcgctccacgctcaaagaggacgtcggtgatgaaggagaagaagaaaaagaattcatttcctataacatcaacatagacattcattatggggttaaatccaatagcttggcattcattaaacgtactcccgtgattgatgcagataaacccgtgtcttctcagctccgggtccttacactcagtgaagactcgccctacgaaactttgcattctttcattagcaatgcagtggctcctttttttaagtcctacattagagagtctggcaaggcagacagggatggtgataaaatggctccttcagttgaaaagaagattgcagaactcgaaatgggactccttcacttgcagcaaaatattgaaattccggagatcagcctgccgattcatccaatgatcacaaatgttgcaaaacagtgttatgagcgtggagaaaagccaaaagttacagactttggtgataaggttgaagacccaacatttcttaatcagttacaatctggagttaaccgctggatccgagaaattcaaaaagtgaccaaactggatcgagatcctgcatcaggaactgccttacaggaaattagtttttggctaaacttggaacgtgcgttataccgcatccaggagaaacgggagagcccggaagttctcctgactctggatatcttgaaacatggcaagcgcttccatgccaccgtcagttttgacactgacacaggtctaaaacaggctttggaaactgtgaatgactacaatcctctgatgaaagatttccctctgaatgatttgctgtctgccacggagctggacaaaataagacaggcgcttgttgccattttcacacatttgagaaagatccgaaacacaaaatatcctattcagagggcactgcgtttggtggaggcaatttcaagagacttgagttctcaattactcaaagtattgggcactaggaaattgatgcatgttgcttatgaagaatttgaaaaagttatggtagcatgctttgaagtttttcagacttgggatgatgagtatgagaaacttcaggtattgttgagagacatcgtcaaaagaaaaagggaagaaaatctgaagatggtgtggcgtatcaaccctgcccacaggaagctgcaggcccgccttgaccagatgagaaaatttagacgccagcatgaacagctaagagctgttatcgtcagggtcctgaggccacaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgcgaataccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactttcttcctgagattatcacactatccaaagaagtccggaacctcaaatggcttggtttccgcgtcccactggcgattgtgaacaaagcccatcaagcaaaccagctttacccgtttgccatctcactgatcgagagcgttcgtacctatgaacggacctgcgagaaggtggaggagcggaacaccatttcccttttggtggctggcttgaaaaaggaagtgcaggccctgatcgcagaaggcattgcgttggtgtgggagtcctacaaacttgacccatatgtacagcgcttagcagagactgtcttcaacttccaagaaaaggtggatgatctgctgatcattgaagaaaaaatagacctagaagtccgttccttggaaacttgtatgtatgaccataagacattctcggaaatcttgaacagagtccagaaagcagtggatgacttaaatctgcactcctattccaatttgcccatctgggtcaacaagcttgacatggagattgaaagaatattgggcgtccgtctgcaagctggcctgagagcttggacgcaggttcttcttggacaagctgaagataaagcagaagttgacatggacacagatgctccacaagttagtcacaagcctggtggagagccaaagatcaaaaatgtcgttcatgagctaagaataaccaatcaggtaatctacttgaatccaccaattgaagagtgcagatacaagctgtatcaggaaatgtttgcctggaagatggttgtactgtctctccccaggatccagagtcagaggtaccaggtgggtgtacattacgaattgactgaggaagagaaattctatcggaatgctttaacacggatgcctgatggccctgttgccctggaagagtcgtattctgctgtcatgggcattgtatctgaagttgaacagtatgtcaaggtttggcttcagtatcagtgtttatgggatatgcaagctgaaaacatctataacagacttggagaagatctcaacaaatggcaggctctcctggtccaaataaggaaggccagaggaacctttgacaatgcagaaaccaagaaagagtttggaccagtagttatagattatggcaaggtacaatctaaggtgaacttgaaatatgactcttggcataaggaggttcttagcaaatttgggcagatgctaggatcaaacatgacggaattccattcccagatctcaaagtcccgccaagagttggagcagcactcagtagacacggccagcacctccgatgcagtgaccttcatcacctatgtgcagtctttgaaacggaagatcaagcagtttgagaagcaagttgagctctaccgcaatggccagcgcttactggaaaagcaaaggttccagttcccaccttcctggctttatattgacaacatcgagggagagtggggagccttcaatgacatcatgcggcgaaaggactctgccattcagcagcaggtggcaaacctgcaaatgaagattgtccaggaggatcgggccgtggaaagccgcaccaccgacctgctgactgactgggagaagaccaagcctgtcacgggcaaccttcgcccagaagaggcacttcaggctctcaccatatatgaggggaagtttggtaggctgaaggacgacagagagaagtgtgcaaaggccaaggaggcgctggaattgacagatactgggcttctcagtggcagtgaagagcgcgtgcaggtggccttagaagaattacaggacctcaaaggcgtttggtcagaactttctaaggtttgggagcaaatcgatcagatgaaggagcaaccctgggtttcagtacagcctcgaaagcttcgacaaaatttggatgccctcctgaaccagctgaaaagcttccctgcccggttgcgacagtatgcgtcctatgagtttgttcagaggcttctgaaaggttacatgaagataaatatgctggtgattgaactgaaatccgaagcacttaaagaccgccattggaaacagctcatgaaaaggcttcacgttaattgggttgtttctgagctaacccttggccaaatctgggatgttgacttgcagaaaaatgaagcgattgtcaaggatgtactgcttgtggcacaaggggagatggctttggaagaatttttgaagcagataagagaagtgtggaatacttatgaactagacttggttaattatcagaacaagtgccgcttgatccgtggctgggatgacctcttcaacaaggtcaaagaacacatcaacagcgtctcggccatgaagctctctccgtattacaaggtttttgaagaggatgctctcagctgggaagataagctgaacaggatcatggctctctttgatgtgtggattgatgtgcagaggcggtgggtctacctggaaggtatcttcacaggcagtgcagatatcaagcacctgctgccagtggaaacccagcggtttcagagcatcagcactgagtttttggctctaatgaaaaaagtgtccaagtctccccttgttatggatgttctgaacatccagggagtacagaggtctctggaaagattggcagacctgctaggaaagatccagaaagcattgggagaatatctggaaagagagcggtcatctttccccaggttctattttgtgggtgatgaagatttgcttgaaatcattggaaacagcaagaatgtcgctaaattacagaaacacttcaagaagatgtttgctggagtttcgagcatcatcctgaacgaggataactctgttgttttgggtatttcatctcgggaaggagaggaggttatgtttaaaactcctgtgtcaattactgaacatcccaaaatcaatgagtggctcacattggtagaaaaggagatgagagtcaccctggccaaactgcttgctgagtctgttacggaagttgagatttttggtaaagcaacttcaattgacccaaatacctacatcacttggattgataaataccaggcccagcttgtggttttgtcagcccagatagcctggtctgagaacgtggagaccgcactgagcagcatgggcggaggtggagatgccgcgcccttgcactctgtgctgagcaatgtggaggtcaccctcaatgtgttagcagactctgtcctcatggagcagcccccactccgaaggcggaagctagaacacttgattacagagttggttcaccagagagatgttacaaggtccttgatcaaaagcaagattgacaacgccaaatcttttgaatggctcagccagatgcgattttactttgaccctaagcaaactgatgtgttacagcagttgtcaattcaaatggcaaatgccaaatttaactatggctttgagtacctgggtgttcaggacaaactggtccagacccccctcactgaccgctgctatttgacaatgacacaagccttggaggccaggctggggggttccccatttggacctgctggaactgggaaaacagagtctgtcaaagctcttggccatcagcttggacggtttgttttagttttcaactgtgatgaaacctttgatttccaggcaatgggccggatctttgtgggcctttgccaggtgggtgcctggggctgctttgacgagttcaaccgcctggaggagcggatgctctcggctgtgtcccagcaggtgcagtgcatacaggaagcactgcgtgaacattccaaccccaactacgacaagacctctgcccccattacttgtgagctgctgaacaaacaagtcaaggtgagcccggacatggccatcttcatcaccatgaaccctggctacgcgggccggtctaaccttcctgacaacttgaagaagctgttccggagcttggccatgaccaagcccgaccggcagttaatcgcccaggtcatgctgtactcacagggtttccgcactgctgaagtgcttgccaacaaaatcgtcccgttttttaaactatgcgatgagcagctctcttcccaaagccattatgacttcggtcttcgggctttgaagagtgtgctggtgagtgcaggcaatgtgaagagagagagaatccagaagataaagagggagaaagaggaacgaggggaagcagttgatgaaggagaaattgctgaaaatctccctgaacaagagattctgatacagagcgtctgtgagacgatggtgccaaagctggtggcagaggacatcccgctgctcttcagcctcctgtcggacgtgttccctggagtccagtatcacaggggtgagatgactgcccttcgagaggagctgaagaaagtgtgtcaggagatgtatttgacatatggagatggagaagaagttggtggaatgtgggttgaaaaggttctccagctctatcagatcacccagatcaatcatggcctgatgatggtggggccctcgggaagtgggaagagcatggcctggcgtgtcctgctgaaggcattggagagactcgagggtgtggaaggtgtggcccatatcatcgaccccaaggccatcagcaaagaccacctctacggaaccctggaccccaacaccagggaatggacagatgggctcttcacacacgtgctgagaaagatcatcgacagcgtgagaggcgagctgcagaagcgccagtggatcgtcttcgatggcgatgtggatccagagtgggttgagaacttgaactcagtgctggatgacaataagctcctaactttgcccaatggagagcgcctcagtcttccacccaatgtgagaataatgtttgaggtacaggacttgaaatacgcgaccttggccacagtgtcgcgctgcggcatggtctggttcagtgaggatgtgctgagcaccgacatgatcttcaacaacttcctggccaggctgcgcagcatcccgctggatgaaggggaggatgaggcacagcggcggcgtaagggcaaagaggatgagggggaggaggccgcttcccccatgctgcagatccaaagagatgcagctacgatcatgcaaccgtacttcacgtccaacggcctggtcaccaaggcgctagagcacgccttccagctggagcacatcatggacctaacacgcctgcgctgcctgggctcgctcttctccatgctgcaccaggcctgccgcaacgtggcgcagtataacgccaaccatcccgacttccccatgcagatcgagcagctggagcgctacattcagcgatatctggtttatgccatactctggtccctgtctggagacagccggctaaaaatgagagcagagctgggtgaatacatcagaagaatcacgaccgtgcctctgcccactgcgcccaacatacccattatcgattatgaggtgtccatcagcggagaatggtctccgtggcaggccaaggtgcctcagattgaagtggagacgcacaaggtggcagcccctgatgtcgtcgtgccaacgctggacacagtccgccacgaagccctcttgtacacttggctggccgaacacaagcccctggtcttgtgtggccctcctgggtctggcaagaccatgacactcttcagcgccctccgggccttgcctgacatggaggtggtgggtctcaacttctccagtgctactactccagagctgcttctgaagacttttgatcactactgcgagtacaggcgcacacctaatggggtggttttggctcctgttcaacttggaaagtggctggtgttgttctgtgatgaaatcaacttgccagatatggataaatatgggacccagagggtcatatccttcatcagacagatggtggagcacggaggcttttaccgtacctcagatcaaacatgggtgaagctggagagaatccagtttgttggggcttgtaatccccccacagaccctggaagaaagcccctctcacacaggttcctgcgccacgtgcctgtcgtgtatgtggattacccgggccccgcctccctcacacagatctacggcaccttcaaccgcgccatgctgaggctcattccatccctgcggacgtatgcagagccgctcactgctgccatggtggagttctacaccatgtctcaggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagatagactcgtagaggatgaggagaggcgttggactgatgagaacatcgacacggttgctctgaagcacttccctaacatcgacagagagaaggcaatgagccgacccatcttgtacagcaactggctgtcaaaggattacatcccagtagaccaagaagagttaagagattatgtcaaagctaggctgaaggtcttttatgaagaagaacttgatgttccgctggtgctgtttaatgaagtcctagaccacgtgctgaggattgacagaatattccgtcaacctcaaggccacttgcttctgattggtgttagtggagcaggaaaaactaccctgtctcgtttcgtcgcctggatgaacggtttgagtgtgtaccagattaaggtccataggaagtacacaggggaagactttgatgaagatctacggacagtgttgagacgttctggctgtaaaaatgaaaagatagcatttataatggatgaatctaatgtgttagattctggattcctggagcgaatgaatacccttctggccaatggagaggtgcctggtctctttgaaggagacgagtatgccaccttgatgacgcagtgcaaagagggggcacagaaggaaggcctgatgctggactcgcacgaggagctctacaagtggttcactagccaggttatccgcaacctccacgtcgtgttcaccatgaacccgtcctcggagggactcaaggaccgggcagctacatcaccagcacttttcaacaggtgtgtgttgaattggtttggagactggtccaccgaagcactgtatcaggttggcaaagaattcacaagtaagatggatctggagaagccaaattacatcgtgcctgattacatgccagttgtgtatgataagctgccgcagccaccatcccatcgggaagccattgtgaacagctgtgtgtttgttcatcagactcttcaccaggcgaatgctcggctagcaaagcgaggcggcagaacgatggccatcacccctcgccactacctggacttcatcaatcactatgccaacctgttccacgagaagcggagcgagctggaggagcagcagatgcacttgaacgtggggctcaggaagatcaaagagacagtcgaccaggtagaagaactgcgtcgtgacttgaggataaagagccaagagctggaggtgaagaatgcagcagccaatgacaagctgaaaaagatggtgaaagaccagcaggaggctgaaaagaagaaggttatgagccaagaaatccaggaacagctgcataagcagcaggaggtaattgcagacaaacagatgagtgtcaaagaagatcttgataaggtggaacctgccgtcattgaggcccagaatgctgtgaagtcgatcaagaagcagcacctggtggaggtgaggtccatggccaaccctcctgctgctgtgaagctggcgctggagtccatctgcctgctgctgggggaaagcaccacagactggaagcagatccgctccatcatcatgcgggagaacttcatccccaccatcgtcaacttctctgcagaggagatcagtgacgccataagggagaagatgaagaaaaattacatgtccaatccaagttacaattatgaaattgtgaatcgggcttccctggcttgcggccctatggtgaaatgggcaattgcacagcttaactatgcagacatgttaaagagagtggagcccctacgcaatgagctgcagaagctggaagatgacgccaaggacaaccagcagaaggccaacgaggtggagcagatgatccgagacctggaagccagcatcgcccgctacaaggaggaatacgccgtcctgatctcagaggcccaggccatcaaggcagacctggcagctgtcgaggcaaaagtaaaccggagcactgctcttctgaagagcttgtctgctgaacgtgaacgatgggaaaaaacaagtgaaactttcaaaaaccagatgtccaccattgctggggactgtctcttgtcagctgcgttcattgcctacgcgggttactttgaccagcagatgcgtcagaacttgttcactacctggtcccatcacctacagcaagccaacatccagttccgtacagatattgccaggacggaatacctttccaatgctgatgagcgtcttcgctggcaggccagctccttgcctgctgatgacctttgcacagaaaatgccatcatgctgaaacgattcaataggtatccgctgatcattgacccctctggacaggccacagaattcattatgaatgaatataaggatcgtaagatcacacggaccagcttcctggatgacgccttcagaaagaacttagagagtgcactgagattcggtaacccccttctggtccaggatgtggaaagctacgatccagttttgaacccggtgctgaaccgtgaagtgcggcgaacaggggggagagtgctgatcactctcggggaccaggacatagacctgtcgccatcgtttgtcatcttcctgtccacccgggatccaactgtcgagttcccaccagatctctgttcccgggttacttttgtaaacttcacagttacccgtagcagtttacaaagccagtgtctaaatgaagtacttaaagcagaaagacctgatgtggacgagaaacgatctgatcttcttaaacttcaaggggaatttcagctccgtttgcgtcagctggaaaaatctctactacaagctctgaacgaggtgaaagggcgcattttggatgacgacacgatcataaccactctggagaacctgaagagagaggctgcagaggtcaccaggaaagttgaggagacggacattgtcatgcaggaggtggagaccgtgtcccagcagtacctcccgctctccaccgcctgcagcagcatctacttcaccatggagtccctcaagcagatacacttcttgtaccagtactccctccagtttttcctggacatttatcacaacgtcctatacgagaacccgaacctgaagggtgtcaccgaccacacacagcgcctgtccattataacaaaggacctcttccaggtggcgtttaaccgagtggctcgaggcatgctgcatcaggaccacattacctttgccatgctgctggcaagaatcaaactgaagggcaccgtgggggagcccacctacgatgcagaattccagcacttcttgagaggaaatgagattgtcctgagtgctggctccacccccaggatccagggcctgactgtggagcaggcggaggcggtggtgaggctgagctgccttcccgcgtttaaggacttgattgcaaaggttcaggcagacgagcaatttggcatctggctggacagcagctccccggagcagactgtgccctacctctggagtgaagaaacacctgcaacacccattggccaggccatccaccgcctgctcctgatccaggctttccggcccgatcgcctgttggccatggcccacatgtttgtttcaacaaaccttggggagtctttcatgtccatcatggagcagccgctcgacctgacccacattgtgggcacagaggtgaagcccaacactcctgtcttaatgtgctctgtgcctggttatgatgccagtggacatgtcgaggaccttgcagccgagcagaacacgcagatcacttcaattgcaatcggctctgcagaaggctttaaccaagcagataaggcaataaacaccgctgtaaagtcgggcaggtgggtgatgctgaagaatgtgcatctggccccagggtggctgatgcagctggagaagaagttgcattccctgcagccgcatgcctgcttccgactcttcctcaccatggagatcaaccccaaggtgcctgtgaatctgctccgtgcgggccgcatctttgtgttcgagccaccgccaggggtgaaggccaacatgctgaggacgttcagcagcattcccgtctcacggatatgcaagtctcccaacgagcgtgcccgcttgtacttcctgctggcctggtttcatgcgatcatccaagaacgcttacgatacgcaccactggggtggtcaaagaagtatgaatttggagagtctgacctgcggtcagcttgcgatacggtggacacgtggctggatgacacggccaagggcaggcagaacatctcaccggataagatcccgtggtctgcactaaagaccttaatggcccagtccatttatggcgggcgcgtggacaacgagtttgaccagcgtctgctcaacaccttcctggagcgcctgttcacaaccaggagtttcgacagtgagtttaagctggcatgcaaggtcgacggacataaagacattcaaatgccagatggcatcaggcgagaggagtttgtgcagtgggtggagttgctccccgacacccagacgccctcctggctgggcctgcccaacaacgccgagagagtcctccttaccacacagggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggatcctttgttcaggttctttgagagagaagtgaagatgggcgcaaagctgcttcaggacgttcgccaggaccttgcagatgtcgtccaggtgtgcgaaggaaagaagaagcagaccaactacttgcgcacgctgatcaacgagctagtgaaagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaccttacctgtctacctgaacttcacccgtgcagacctcatcttcaccgtggacttcgaaattgctacaaaggaggatcctcgcagcttctacgagcggggtgtcgcagtcttgtgcacagagtaaacttttctagctgcccctttctgtaatagtgaaagttggtatttaacatttattcatttttaaaatatttggaaggtctgagcttgtgaaaagaaagtggttggtctgaggttggaggaagctgaatggaatctgacggttgggagtggtggaaattggaaggataccaggaggtatttgggaaggccaatggcgtggctcctttgaggaaataaaacactaagcatg

SEQ ID NO: 9030 - DNA, 2587 bp, Homo sapiens
cttctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctaggacgctgcattgggatacagatccatcagttcttcagcttcactcagattccgatttgggacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgtt

SEQ ID NO: 9031 - DNA, 2589 bp, Homo sapiens
aattcccagaacgcactgctcgtcgcacgcaggttttccttgttgccggggtttgtagttcttctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaa

SEQ ID NO: 9032 - DNA, 2211 bp, Homo sapiens
agttggtgttgggggcttaggcgagggacgttaccgggaagttgcaggcgggaggactcttccccatccagtcacctgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgctgagcaacctctccgtgtagtaacagcggatacctgtctatttcactatttagtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagc

SEQ ID NO: 9033 - DNA, 2604 bp, Homo sapiens
ttctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgttttttctgaatactgggtccctcctcctatgtctccatcctccaaatctgtgagcactccaagtgaagctggaagccaagactctggagatggcgccgtgggatctaggacgctgcattgggatacagatccatcagttcttcagcttcactcagattccgatttgggacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgtt

SEQ ID NO: 9034 - DNA, 2572 bp, Homo sapiens
ttttatttctgggagcgacctcgttctggtgaggctatttgtccctaagctctcgccgtagcagccgccgcccatccctctttgtgtgctttggaaagccgcggagctggtggtggctacagttggtgttgggggcttaggcgagggacgttaccgggaagttgcaggcgggaggactcttccccatccagtcacctgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaa

SEQ ID NO: 9035 - DNA, 2196 bp, Homo sapiens
atttgtccctaagctctcgccgtagcagccgccgcccatccctctttgtgtgctttggaaagccgcggagctggtggtggctacagttggtgttgggggcttaggcgagggacgttaccgggaagttgcaggcgggaggactcttccccatccagtcacctgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctaggacgctgcattgggatacagatccatcagttcttcagcttcactcagattccgatttgggacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggt

SEQ ID NO: 9036 - DNA, 2552 bp, Homo sapiens
agctggtggtggctacagttggtgttgggggcttaggcgagggacgttaccgggaagttgcaggcgggaggactcttccccatccagtcacctgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgttttttctgaatactgggtccctcctcctatgtctccatcctccaaatctgtgagcactccaagtgaagctggaagccaagactctggagatggcgccgtgggatctaggacgctgcattgggatacagatccatcagttcttcagcttcactcagattccgatttgggacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaacttttcaaa

SEQ ID NO: 9037 - DNA, 2583 bp, Homo sapiens
catccctctttgtgtgctttggaaagccgcggagctggtggtggctacagttggtgttgggggcttaggcgagggacgttaccgggaagttgcaggcgggaggactcttccccatccagtcacctgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgttttttctgaatactgggtccctcctcctatgtctccatcctccaaatctgtgagcactccaagtgaagctggaagccaagactctggagatggcgccgtgggatctaggacgctgcattgggatacagatccatcagttcttcagcttcactcagattccgatttgggacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaactttt

SEQ ID NO: 9038 - DNA, 2494 bp, Homo sapiens
cggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgtccctcctcctatgtctccatcctccaaatctgtgagcactccaagtgaagctggaagccaagactctggagatggcgccgtgggatctagacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgttaa

SEQ ID NO: 9039 - DNA, 2605 bp, Homo sapiens
cttctcgatcgtgtcagtttgtaaggcgagggcggaagttggattcctggcctgagaatattaggcgtagttttccagtttttggcaaagcggaaatacttaaggcccctgggttgactgggttctttgttttatctaccggcttctgctttacgacaggtcacaaacatgtcagacaaaagtgaattaaaggctgagttggaacgtaagaagcagcgactggcccaaatcagagaggaaaagaagagaaaagaagaagaaaggaaaaaaaaagaaacagaccagaagaaggaagctgttgctcctgtgcaagaagaatcagatcttgaaaaaaaaaggagagaagctgaagcattgcttcaaagcatggggctaactccagaatcccccattgacatagctgagtatttagtccctcctcctatgtctccatcctccaaatctgtgagcactccaagtgaagctggaagccaagactctggagatggcgccgtgggatctaggacgctgcattgggatacagatccatcagttcttcagcttcactcagattccgatttgggacgaggacctattaaacttggaatggctaaaatcacgcaagtcgactttcctcctcgagaaattgtcacgtatacaaaggaaactcagactccagttatggctcaacccaaagaagatgaagaggaagatgatgatgtagtggctcctaaaccacctattgaacctgaagaagagaaaactttaaagaaagatgaggaaaatgatagtaaagctccccctcatgagctgactgaagaagaaaagcaacaaatcttgcactctgaggaatttttaagtttctttgaccattctacaagaattgtagaaagagctctttctgagcagattaacatcttctttgactatagtgggagagatttggaagacaaagaaggagagattcaagcaggtgctaaactgtcattaaatcgacaattttttgacgaacgttggtcaaagcatcgggtggttagttgtttggattggtcatctcagtatccggagttactcgtggcttcctataacaacaatgaagatgcccctcatgagcctgatggtgtggcccttgtatggaatatgaaatacaaaaaaactaccccagagtatgtgtttcactgccagtcagctgtgatgtctgccacatttgcaaaatttcatccaaatcttgttgttggtggtacatattcaggccaaattgtgctttgggataaccgtagcaataaaagaactccagtgcaaagaactccactgtcagcagctgcacacacacaccctgtatattgtgtaaatgttgttggaacacaaaatgctcacaatctgattagcatctctactgatggaaaaatttgttcatggagtctggacatgctttcccatccacaggatagcatggagttggttcataaacagtcaaaagcagtagctgtgacatctatgtccttccctgttggagatgtcaacaactttgttgttgggagtgaagaaggttctgtgtacacagcatgccgccatggcagcaaagctggaatcagtgagatgtttgaggggcatcaaggaccaatcactggcatccattgtcatgcagctgttggagcagtagacttctcacatctttttgtcacttcatcgtttgactggacagtaaagctttggacaactaagaataacaagcctttgtattcatttgaagataatgcagactatgtttatgatgttatgtggtcacctacccacccagccctgtttgcctgtgtggatggcatggggagattggatttgtggaatctcaataatgacacagaggtaccaactgccagcatttctgtggagggtaatcctgctcttaatcgtgtgagatggacccattctggcagagagattgctgtgggtgattctgaaggacagattgttatatacgatgtgggagagcagattgctgttccccgcaatgatgaatgggcacggtttggccgaacacttgcagaaattaatgcaaaccgagctgatgcagaggaggaagcagctacccgaatacctgcttagttcctgaaaaggggagtgtaactagtggatttgggaaaggttcttaagtagatcctgagactatttgcatgcttctgtctaaatgataattaaaaggaaatttcatggattaaaccatgggtttaatgcagcaaggaaacttacaatgtccctttatatataacatgcatcttgttttggatttgtgtcattttttaatatagctgattgacttcacagaaagcagcttttttgaattctaatacataggtgtatatttggtattagttattttgagttcttttcaacttataacactgtatacagttatttctaaagcacagatgaaataagttctgcatatttttaaataatcacagttccctgttatacagataatgttctcactacccataatatgtaggaacattgtttctccttagccgtagtatgcatacacctatccatgttcattctgacatcctttgttgtctttataattcatgtggtagttacctataaataaaaacaaatatgcgtt

SEQ ID NO: 9040 - DNA, 2984 bp, Homo sapiens
ctggtttcttcttccttcccccttcccccaacttccctccaccccttccaatcatggcgaacgggactgcggacgttcggaagctcttcatcttcactactacccagaattacttcgggttgatgtctgaactctgggatcagccactgttgtgcaactgtcttgaaatcaacaacttcttggatgacggcaaccagatgctcctcagggtgcagcgatccgacgcaggaatctccttttccaacacgattgagtttggtgacacaaaagataaagtgctggtgtttttcaagctgcgacctgaagtaattactgatgagaatctacatgataacattcttgtttcatctatgttagagtcacctattagttctctttaccaagcagtacggcaagtattcgcaccaatgttgttaaaggatcaggaatggagcagaaactttgatcccaaacttcagaatcttttgagtgaactagaagctgggttgggtatagttctacgaagatcagacactaacttaacaaaattgaaatttaaggaagatgacacacgaggtatccttacaccaagcgatgagttccagttttggatagaacaagctcaccgtggaaataaacagattagtaaagaaagagccaattattttaaagaattatttgaaacaattgcaagagagttttataacttggacagtctatccttactagaagttgttgacttggtggagactactcaggatgttgtagatgatgtgtggagacaaacagaacatgatcattatcctgagtcacgaatgttgcatctcttagacatcataggtggttcatttggaaggtttgttcagaaaaagttgggaactttgaacctgtgggaagatccttattatcttgtgaaagaaagtctgaaagctggtatttcaatttgtgaacagtgggtgatagtctgtaatcatctaacaggtcaggtgtggcagcgctatgttcctcatccatggaaaaatgaaaaatattttccagaaacacttgacaaacttggcaaacgccttgaagaggtcttggctattagaacaattcatgagaagtttctctattttctacctgccagtgaagagaaaatcatatgcctcactcgagtatttgaaccttttactggcctgaatcctgtgcaatataatccatatactgagcccttgtggaaagctgcggtgtctcaatatgaaaagattattgcacctgcggaacaaaaaatagcaggaaaattgaaaaattatatttcagaaattcaagacagtccacagcagcttcttcaagcattcctgaaatataaagagttggtaaagcgtccaactataagcaaagaattgatgttagaaagagaaactttactggcaagacttgtggactcaattaaagattttcgattagactttgagaatcggtgccgaggaattcctggtgatgcatctggaccactttctggcaaaaatctttcagaagttgtcaacagtatagtttgggttcgccagttggaattgaaggtagatgatactatcaagattgcagaggctcttttatctgacttgccaggatttcgatgtttccatcaaagtgccaaagatctcttagaccagcttaaactatatgaacaggaacaatttgatgattggtccagggatattcaatcaggtttatctgattccagatctggtttgtgtattgaggctagtagtcgaattatggaattggattctaatgatggattactaaaagtgcattattcagatcgtttggtgattcttctgagagaagttcgtcagctctctgcacttggctttgttattcctgccaaaatacagcaagttgcaaacattgcacagaaattctgcaagcaagcaattattcttaaacaagtggcacatttttataattctattgatcaacaaatgattcaaagtcagaggccaatgatgttacaatctgccttagcatttgaacagataattaagaattcaaaagcaggaagtggagggaaatcacagataacttgggataatcctaaagaattagaaggctatatccaaaaactccaaaatgctgctgaacggcttgccactgaaaatagaaaactgagaaaatggcacactacattttgtgaaaaggtggttgttcttatgaatattgatctgcttcggcagcaacagcgctggaaagatggattacaagaattgagaactggcttagcaactgtagaagcacagtgtcctctcgcatggcagagcaagtgggaaggcccagaagatcccttacaatacctgagaggtcttgttgcccgtgcccttgcaatacagaactgggtagataaagctgaaaaacaggctcttctctctgaaacacttgacctatcagaacttttccatccagacacatttcttaatgctcttcgccaggaaactgcaagggcagtgggtcgttctgtggatagccttaaatttgtagcctcatggaaaggtcgactgcaagaagcaaagctacaaattaagatcagtggcttgttactagaaggatgtagttttgatggaaatcaactttctgaaaatcagcttgattctcccagcgtgtcatcagtgctcccttgttttatgggctggattccacaggatgcatgtggtccatattctccggatgagtgcatctctttgcctgtttacacaagtgctgaaagggatcgtgtggttaccaatattgatgttccatgtgggggcaaccaagaccagtggattcagtgtggagcagctctattcctaaaaaatcagtagaatctaatgacaacaaaagccatcttcacaaaagggaacattgattctttaagctttaaatcaaacatgtggtcagtctacatttgaaatgttagttcaaaatattaacatatagttatgttgttgatgtcactgaaattttaatgtgtaaaagcagcactgtgcatc

SEQ ID NO: 9041 - DNA, 13678 bp, Homo sapiens
gactacccctggcaaccgcgaagctctgcggtcccgcggtcgggctacgggtttgagcaaagctcctctcttcccttcacttccctccggactggtttcttcttccttcccccttcccccaacttccctccaccccttccaatcatggcgaacgggactgcggacgttcggaagctcttcatcttcactactacccagaattacttcgggttgatgtctgaactctgggatcagccactgttgtgcaactgtcttgaaatcaacaacttcttggatgacggcaaccagatgctcctcagggtgcagcgatccgacgcaggaatctccttttccaacacgattgagtttggtgacacaaaagataaagtgctggtgtttttcaagctgcgacctgaagtaattactgatgagaatctacatgataacattcttgtttcatctatgttagagtcacctattagttctctttaccaagcagtacggcaagtattcgcaccaatgttgttaaaggatcaggaatggagcagaaactttgatcccaaacttcagaatcttttgagtgaactagaagctgggttgggtatagttctacgaagatcagacactaacttaacaaaattgaaatttaaggaagatgacacacgaggtatccttacaccaagcgatgagttccagttttggatagaacaagctcaccgtggaaataaacagattagtaaagaaagagccaattattttaaagaattatttgaaacaattgcaagagagttttataacttggacagtctatccttactagaagttgttgacttggtggagactactcaggatgttgtagatgatgtgtggagacaaacagaacatgatcattatcctgagtcacgaatgttgcatctcttagacatcataggtggttcatttggaaggtttgttcagaaaaagttgggaactttgaacctgtgggaagatccttattatcttgtgaaagaaagtctgaaagctggtatttcaatttgtgaacagtgggtgatagtctgtaatcatctaacaggtcaggtgtggcagcgctatgttcctcatccatggaaaaatgaaaaatattttccagaaacacttgacaaacttggcaaacgccttgaagaggtcttggctattagaacaattcatgagaagtttctctattttctacctgccagtgaagagaaaatcatatgcctcactcgagtatttgaaccttttactggcctgaatcctgtgcaatataatccatatactgagcccttgtggaaagctgcggtgtctcaatatgaaaagattattgcacctgcggaacaaaaaatagcaggaaaattgaaaaattatatttcagaaattcaagacagtccacagcagcttcttcaagcattcctgaaatataaagagttggtaaagcgtccaactataagcaaagaattgatgttagaaagagaaactttactggcaagacttgtggactcaattaaagattttcgattagactttgagaatcggtgccgaggaattcctggtgatgcatctggaccactttctggcaaaaatctttcagaagttgtcaacagtatagtttgggttcgccagttggaattgaaggtagatgatactatcaagattgcagaggctcttttatctgacttgccaggatttcgatgtttccatcaaagtgccaaagatctcttagaccagcttaaactatatgaacaggaacaatttgatgattggtccagggatattcaatcaggtttatctgattccagatctggtttgtgtattgaggctagtagtcgaattatggaattggattctaatgatggattactaaaagtgcattattcagatcgtttggtgattcttctgagagaagttcgtcagctctctgcacttggctttgttattcctgccaaaatacagcaagttgcaaacattgcacagaaattctgcaagcaagcaattattcttaaacaagtggcacatttttataattctattgatcaacaaatgattcaaagtcagaggccaatgatgttacaatctgccttagcatttgaacagataattaagaattcaaaagcaggaagtggagggaaatcacagataacttgggataatcctaaagaattagaaggctatatccaaaaactccaaaatgctgctgaacggcttgccactgaaaatagaaaactgagaaaatggcacactacattttgtgaaaaggtggttgttcttatgaatattgatctgcttcggcagcaacagcgctggaaagatggattacaagaattgagaactggcttagcaactgtagaagcacagggattccaagcaagtgacatgcatgcatggaaacaacactggaatcatcaactgtacaaagctctggagcatcagtaccagatgggcttagaagcacttaatgagaatttgccagaaataaatatagacttaacttacaaacagggacgattacaattcaggcccccttttgaagaaatccgggctaaatattatagagaaatgaagagattcatcggcattccaaatcagtttaagggagtgggtgaggcaggagatgaatctattttttctattatgattgatagaaatgcaagtggatttttgacgattttcagcaaagcagaagatctgtttagaagattgtcagctgttttacaccaacataaggaatggattgtaattgggcaagttgatatggaagctctggtggaaaagcatctttttactgtacatgattgggagaaaaattttaaagcattaaaaataaaggggaaagaagtagaacgacttccaagtgctgtcaaggtagattgtttaaatattaattgcaaccctgtgaagactgtgattgatgatctcatccagaagttatttgatctgcttgttctttctttgaagaagtccatacaggctcatttacatgaaattgatacatttgttactgaggctatggaagtcttaacaattatgccccagtctgtggaagaaattggtgatgcaaatctacaatatagtaagttacaagaacggaagccagagattttgcccttatttcaagaagctgaagacaaaaacagacttttacgaactgtggctggtggaggtttagaaacaattagtaatttgaaagccaagtgggataaatttgagttaatgatggaaagtcaccaacttatgattaaagaccagattgaagtgatgaaaggaaatgtgaaatcacgtcttcagatctattatcaagaactggaaaaatttaaagctcgttgggaccaactaaagcctggtgatgatgttattgaaactggccaacataatactcttgataaaagtgcaaagttaataaaagagaaaaaaattgagtttgatgatcttgaagtcacaagaaaaaagctggttgatgattgccatcattttagactggaagagcctaatttctccctggcaagtagtatctctaaagatatcgagagctgtgcccaaatttgggccttttatgaagagtttcaacaaggatttcaggaaatggccaatgaagactggatcacttttcggactaagacatacctgtttgaggaatttttgatgaactggcatgacagattaaggaaggttgaagaacattcagtgatgacagtgaaattacaatcagaggttgacaaatataaaatcgtaattcctatcttgaaatatgtgagaggggagcatctttctccagatcactggcttgacctttttcgtctccttggacttcctagggggactagtctagagaaactactgtttggtgatttgctcagagtagctgatacaattgtagccaaagctgccgaccttaaagatttaaatagtcgggcacaaggtgaagttacaatcagagaagctttacgtgaacttgatctttggggagttggagcagtgtttacattaattgattatgaagacagccaaagtcgaactatgaagctgattaaagactggaaagatatagtaaatcaggttggagataatagatgccttctccaatccttaaaggattctccttattataaaggatttgaagataaagtatcaatttgggaaagaaaacttgcagagttagatgaatacctgcagaatttaaatcatattcagagaaagtgggtgtatttggaacccattttcggccgtggagcattgccaaaagaacagacacgcttcaacagagttgatgaagattttagatcaataatgactgatatcaagaaagacaatagagtcacaacattaactactcatgctggaataagaaattctctactaacaatacttgatcagcttcaaagatgtcagaaatcattaaatgaatttttggaggaaaaacgctcagcattcccaagattttattttattggtgatgatgacttattagaaatattgggccagtctaccaacccatcagtgattcagtctcacctgaagaagctttttgctggtattaacagtgtttgctttgatgagaaatcaaaacatataactgcaatgaaatctttagagggagaagttgtaccttttaaaaataaagttcctctatcaaataatgtagagacatggttgaatgatttggccttagaaatgaagaaaactttggaacagttgttgaaggaatgtgttactactgggcgaagttctcaaggtgcagttgacccatctctgttcccttcacagattttatgcttggcggagcagattaaattcactgaagatgtagaaaatgctattaaagatcatagtcttcatcagattgaaacacaactggtgaataagttagagcaatatactaacattgatacaagttctgaggatccagggaatactgaatcgggcatcctggagcttaaacttaaagccctaattcttgacattatccataatattgatgtggtaaagcagttaaaccaaattcaggttcatacaactgaagactgggcttggaaaaaacaacttagattctatatgaaaagtgatcatacatgttgtgttcaaatggtggattctgaatttcagtatacttatgaatatcagggtaatgcttccaaactggtttatactccactgacagacaagtgctacttaactctcactcaagccatgaagatgggacttggaggaaatccttatggaccagctggaactgggaaaacggaatcagtaaaggctttaggtggacttcttggaagacaagttttagtctttaattgtgatgagggcatcgatgtgaagtcaatgggacgaatatttgttggtttggtgaagtgtggggcctggggttgttttgatgaatttaataggctggaagaatctgtactgtcagcagtttctatgcaaatccagacaattcaagatgctttgaagaatcatagaactgtatgtgaactgcttggcaaggaggtagaagtaaattctaattctggaatttttatcactatgaatcctgctggaaaaggttatggaggaagacaaaaactgcctgataatcttaaacagcttttcaggcccgtagctatgtctcatccagacaatgagcttattgcagaagttattctctattcggaaggctttaaagacgctaaagtattgagcagaaaattggtagctattttcaatctatctagggaacttttgacacctcagcaacattatgattggggtttgagagctttgaagacagttctgagaggaagtggaaatctccttagacagctaaacaaaagtggcactacacagaatgctaatgaaagtcatattgtggtacaagcactgaggcttaataccatgtcaaagtttacgtttactgattgcacccggtttgatgcactgataaaagatgtctttccgggaattgaattgaaagaagtggaatatgatgaactaagtgctgcattaaagcaggtctttgaagaggccaattatgaaattatacccaatcagatcaaaaaggctttagaattgtatgaacagttatgccagaggatgggagttgttattgttggtccaagtggtgctggaaaatcaacgctttggagaatgttaagggctgcgctttgtaaaactggcaaagtagtgaaacaatatactatgaatcccaaagctatgcctcgatatcaattattaggccatattgacatggacacaagagaatggtctgatggtgttttgacaaatagtgctcgtcaagtggttcgggaacctcaagatgtcagctcatggataatctgtgatggtgatattgaccctgaatggatagaatctctgaattctgttctggatgataatcgactgctgactatgcccagtggagaaaggattcagtttggcccaaatgttaactttgtatttgaaactcatgatttaagttgtgcatcaccagccacaatatctagaatgggaatgatctttcttagtgatgaagagacagatcttaattctctgataaaatcttggttgaggaatcagcctgctgaatatagaaataatcttgaaaattggattggagattattttgaaaaggctttacaatgggttctaaagcagaatgactatgtggtagaaacaagtttggttgggactgtgatgaatggtttgtcacatctacatggttgcagagatcatgacgaattcattattaatctcataaggggacttggtggaaatctgaatatgaagtcacgtttggaatttaccaaagaggtttttcattgggcacgagaatctcctccagactttcacaaacctatggatacctactatgactctactaggggtcgattagcaacatatgtgcttaagaagccagaagacttgactgctgatgatttcagtaacggcttaactcttccagtcattcagactcctgacatgcaacgaggtctagattatttcaaaccatggttaagttctgatactaaacagccctttattctggtaggaccagaaggatgtggcaaagggatgctgctcaggtacgcattttcacaactccggtccactcaaattgctacagttcactgtagtgcacaaaccacttctcgacatctcctgcagaaactgagccagacttgcatggtaatcagtactaatactggtcgtgtatacagaccaaaagactgtgaaagacttgttctgtacttaaaagatatcaacctacctaaacttgataaatgggggaccagtactttggtagcattcctacaacaggtattgacgtatcaaggattttatgatgaaaatttggaatgggttggtctagaaaatattcaaattgtggcttctatgtcagctggaggaagactgggaagacataaacttactaccagatttacttccatcgttcgtctttgttctatagattacccagaaagagagcagttacaaacgatttatggagcatatttggaaccagttctacataaaaatctgaagaatcattctatttggggttcttcatcaaaaatttatcttttagcaggatctatggtacaagtgtatgaacaggtgcgagccaaatttacagttgatgattatagtcactatttctttactccttgcattcttacccaatgggttcttggcttatttagatatgatttagaaggaggatcctcaaaccatccactagattatgtgttagaaattgtagcatatgaggcacggcgcttatttcgtgacaaaattgttggtgcaaaggaacttcatttatttgacatcattttaacatcagtgtttcaaggagattggggctcagacatattagacaatatgtcagatagtttctacgttacatggggagctcggcataattcaggagcaagggcagccccaggacaaccattacctccacatggaaaaccacttggaaaactaaactctactgatctcaaggatgttattaaaaagggtcttattcattatggacgagataaccagaatttagacattttacttttccacgaagtcttggagtatatgtctaggatagatagagtgctgagtttccctggaggttcacttctattagcaggacgcagtggtgtaggtcgtcggaccatcacttctttagtcagtcacatgcatggagcggtcctgttttctccaaagatttccagaggatatgaactgaagcagttcaaaaatgatctcaaacatgtgctgcaacttgcaggaattgaagcacaacaggtagttttacttcttgaggattaccagtttgtacatcctacatttttggagatgatcaatagccttttgtcttcaggtgaagttcctggactctatactcttgaagaattagagcccttgctgttaccacttaaggatcaagcttcacaagatggtttttttggaccagtcttcaattacttcacatatagaattcagcaaaacttgcatattgtcttgataatggattctgcaaattcaaacttcatgataaactgtgagagtaatccagctttgcataagaaatgccaggtgttgtggatggagggttggtccaatagcagtatgaagaaaatacctgaaatgttattcagtgaaacaggtggtggagaaaaatacaatgataaaaaacgaaaagaagaaaagaaaaaaaattcagttgatcctgattttctaaaatcatttttattaatccatgaatcttgtaaagcatatggtgctacaccaagccgatacatgacctttttacatgtgtattctgccattagtagtagcaagaaaaaggaattattaaaaagacaaagtcatttgcaggctggtgtatctaaactaaatgaagctaaagctcttgtggatgaactgaacagaaaagctggagaacaaagtgtgttacttaaaacgaagcaagatgaagcagatgctgcccttcaaatgatcacagtgtcaatgcaggatgctagtgagcaaaaaacagaacttgaaagactgaagcacagaatagcagaagaagttgttaaaattgaagaaagaaaaaataaaattgatgatgaattaaaagaagtacaacctttagtcaatgaagctaaactagcagttggaaacattaagcccgaatcactttcagaaattcgctcactacgcatgccacctgatgtaattagagatattcttgaaggagttttaaggttgatgggtatctttgatacatcttgggtgagcatgaaaagtttccttgcaaaaagaggtgtaagagaagacatagcaacctttgatgcccgaaatatttcaaaggaaataagagagagtgttgaagaacttctttttaaaaataaaggctcttttgatccaaagaatgctaagcgtgccagtactgcagctgcacctttggctgcctgggtgaaagccaatattcagtattcccatgtcttggaacgaattcatcctttggaaactgaacaggcaggattagaatcgaatctgaagaaaactgaagacagaaaaaggaaactagaggagcttcttaattctgttggtcaaaaggtatcagaactcaaagaaaaatttcagagcaggacttcagaagctgccaaacttgaggctgaagtaagcaaggcacaagaaacaatcaaagctgcagaagtcttaattaatcagcttgacagagaacataagagatggaatgcacaggttgtagagataacagaggaattagctactcttcctaaaagagctcaacttgctgctgcatttattacatatctttctgctgctcctgaatctctgagaaaaacctgtttggaagaatggaccaagtcagctggtcttgagaaatttgatctgaggagatttctttgtactgaaagtgagcagttaatttggaaaagtgaaggcctaccatcagatgacctttccatagaaaatgctcttgtaatattacagagtcgagtgtgcccatttcttatagatccttcttcccaagctacagagtggttaaaaacacatttgaaagactcacgtttagaagttatcaatcagcaggatagtaactttatcacagctcttgaattagcagtacgttttgggaaaacccttattatacaagagatggatggtgtagaacctgttctttatccattattgagacgagatctggttgctcaaggaccacgttatgtggtacaaataggtgacaaaattattgactacaatgaagaattccgcctctttttgtcaacaagaaacccaaatccttttattccaccggatgcagcttccattgttactgaggttaactttactacaacaagaagtggattacgagggcagcttttagctttaaccattcagcatgagaaacctgatttagaagaacagaaaacaaaactattacaacaggaagaagataagaaaatacagctagccaagctcgaagaatctcttctagagacacttgccacatctcaaggcaatattttggaaaataaggatttgattgagtctttgaatcagacaaaagcaagcagtgcacttattcaagagtcacttaaagaatcttacaaactccaaatttcccttgatcaagaacgggatgcctatctccccctggctgagagtgccagcaagatgtacttcattatttctgatttgtccaaaattaataacatgtaccgttttagtttggctgcttttctccgacttttccaacgagctctacaaaacaaacaggattctgaaaatacagaacagagaatccagtcacttatcagctcattacaacatatggtatatgaatatatatgtcgttgtctatttaaggctgatcagttgatgttcgctttgcattttgttcgaggcatgcatcctgaactttttcaagaaaatgaatgggatacgtttacaggtgtggttgttggagacatgttacggaaagctgactctcaacaaaaaatacgtgatcagcttccgtcttggatagatcaggaacgaagctgggccgtggcaacattaaagattgctctccccagtctttatcagaccctctgctttgaagatgcagctctgtggcgtacttattataataattcaatgtgtgagcaagagtttccatctatccttgcaaagaaagtttccttatttcagcagattcttgtagtacaggcgctaagaccggacagattgcaaagtgccatggctctttttgcatgtaaaactctgggactgaaagaggtgtccccactgcctctaaatctcaaacgtttatacaaagagacactggaaattgaacccatcttgataattatttctccgggtgctgatccttctcaggaacttcaagaactagctaatgctgaaagaagcggagagtgttatcaccaggttgccatgggtcaaggtcaagctgatttagcaattcaaatgctaaaagaatgtgcccgcaatggagactggctctgtttgaagaacttacatcttgtggtatcttggctgccagttctggaaaaggaattgaatactcttcaacctaaagatacctttcgtctttggctcactgcagaagttcatcccaactttactcctattttactacagtcaagtctgaagataacatatgagtcacctccaggtttaaagaagaatttaatgcgtacttatgagtcttggactcctgagcaaattagcaaaaaagataatacacatcgagctcatgctctcttcagtcttgcatggtttcatgctgcatgtcaagaaagaagaaactatattcctcagggttggacaaagttttatgaattttctttatcagatcttcgggctgggtacaacattattgacagactttttgatggtgccaaagatgtacaatgggaatttgtacatggtttacttgaaaatgctatttatggaggacgtatagacaactattttgaccttagagttcttcagtcatacctgaagcagttttttaattcttcagttattgatgtattcaaccaaaggaacaagaaaagcatttttccatattccgtatctctaccacaatcctgcagcattttggactatcgtgctgtcattgagaaaattccagaggacgacaaacctagtttctttggtctgcctgccaatatcgctcgctcatctcagcgcatgatcagttctcaggttatttcacagttgaggattttgggcagatccataacagctggttccaaatttgatagagaaatctggtctaatgaactttctcctgtcctcaatctctggaagaaactaaaccagaattcaaacctaatacatcagaaagtgcctcctcctaacgatcgacaaggatctccaatactgtcattcatcattcttgaacaatttaatgctattcgtttagtacaaagtgtccaccagtctcttgctgctctcagcaaagtcatcagaggaactactttactgagttcagaagtacaaaaattggcaagtgctttattaaaccaaaagtgtcctctcgcatggcagagcaagtgggaaggcccagaagatcccttacaatacctgagaggtcttgttgcccgtgcccttgcaatacagaactgggtagataaagctgaaaaacaggctcttctctctgaaacacttgacctatcagaacttttccatccagacacatttcttaatgctcttcgccaggaaactgcaagggcagtgggtcgttctgtggatagccttaaatttgtagcctcatggaaaggtcgactgcaagaagcaaagctacaaattaagatcagtggcttgttactagaaggatgtagttttgatggaaatcaactttctgaaaatcagcttgattctcccagcgtgtcatcagtgctcccttgttttatgggctggattccacaggatgcatgtggtccatattctccggatgagtgcatctctttgcctgtttacacaagtgctgaaagggatcgtgtggttaccaatattgatgttccatgtgggggcaaccaagaccagtggattcagtgtggagcagctctattcctaaaaaatcagtagaatctaatgacaacaaaagccatcttcacaaaagggaacattgattctttaagctttaaatcaaacatgtggtcagtctacatttgaaatgttagttcaaaatattaacatatagttatgttgttgatgtcactgaaattttaatgtgtaaaagcagcactgtgcatcttttaaagtaataaattaatggagttattgttaaaacagagtattcttttgacaacattaaatatttctgtgagaaagttcacttttccagtggctcaaaaatttgttttaggtcagagattttaagtggtatattaaccaataataaatattttggctgtcatttgtgtcataattatttaataaaagagcattcataatttttgcagtcttcccatgactctttttacatactgaagaatgtattataaagttataatgaatgtataaaagtatcaacatgaatataattatactatgctaattataatatacaaatatataattattgtcataattatatacttataactaatatcttaaggtaattcaaataggaataattcaggtgacataataatggaggataaattctggttattaaacattcagcttttttgtg

SEQ ID NO: 9042 - DNA, 12945 bp, Homo sapiens
atggcgaacgggactgcggacgttcggaagctcttcatcttcactactacccagaattacttcgggttgatgtctgaactctgggatcagccactgttgtgcaactgtcttgaaatcaacaacttcttggatgacggcaaccagatgctcctcagggtgcagcgatccgacgcaggaatctccttttccaacacgattgagtttggtgacacaaaagataaagtgctggtgtttttcaagctgcgacctgaagtaattactgatgagaatctacatgataacattcttgtttcatctatgttagagtcacctattagttctctttaccaagcagtacggcaagtattcgcaccaatgttgttaaaggatcaggaatggagcagaaactttgatcccaaacttcagaatcttttgagtgaactagaagctgggttgggtatagttctacgaagatcagacactaacttaacaaaattgaaatttaaggaagatgacacacgaggtatccttacaccaagcgatgagttccagttttggatagaacaagctcaccgtggaaataaacagattagtaaagaaagagccaattattttaaagaattatttgaaacaattgcaagagagttttataacttggacagtctatccttactagaagttgttgacttggtggagactactcaggatgttgtagatgatgtgtggagacaaacagaacatgatcattatcctgagtcacgaatgttgcatctcttagacatcataggtggttcatttggaaggtttgttcagaaaaagttgggaactttgaacctgtgggaagatccttattatcttgtgaaagaaagtctgaaagctggtatttcaatttgtgaacagtgggtgatagtctgtaatcatctaacaggtcaggtgtggcagcgctatgttcctcatccatggaaaaatgaaaaatattttccagaaacacttgacaaacttggcaaacgccttgaagaggtcttggctattagaacaattcatgagaagtttctctattttctacctgccagtgaagagaaaatcatatgcctcactcgagtatttgaaccttttactggcctgaatcctgtgcaatataatccatatactgagcccttgtggaaagctgcggtgtctcaatatgaaaagattattgcacctgcggaacaaaaaatagcaggaaaattgaaaaattatatttcagaaattcaagacagtccacagcagcttcttcaagcattcctgaaatataaagagttggtaaagcgtccaactataagcaaagaattgatgttagaaagagaaactttactggcaagacttgtggactcaattaaagattttcgattagactttgagaatcggtgccgaggaattcctggtgatgcatctggaccactttctggcaaaaatctttcagaagttgtcaacagtatagtttgggttcgccagttggaattgaaggtagatgatactatcaagattgcagaggctcttttatctgacttgccaggatttcgatgtttccatcaaagtgccaaagatctcttagaccagcttaaactatatgaacaggaacaatttgatgattggtccagggatattcaatcaggtttatctgattccagatctggtttgtgtattgaggctagtagtcgaattatggaattggattctaatgatggattactaaaagtgcattattcagatcgtttggtgattcttctgagagaagttcgtcagctctctgcacttggctttgttattcctgccaaaatacagcaagttgcaaacattgcacagaaattctgcaagcaagcaattattcttaaacaagtggcacatttttataattctattgatcaacaaatgattcaaagtcagaggccaatgatgttacaatctgccttagcatttgaacagataattaagaattcaaaagcaggaagtggagggaaatcacagataacttgggataatcctaaagaattagaaggctatatccaaaaactccaaaatgctgctgaacggcttgccactgaaaatagaaaactgagaaaatggcacactacattttgtgaaaaggtggttgttcttatgaatattgatctgcttcggcagcaacagcgctggaaagatggattacaagaattgagaactggcttagcaactgtagaagcacagggattccaagcaagtgacatgcatgcatggaaacaacactggaatcatcaactgtacaaagctctggagcatcagtaccagatgggcttagaagcacttaatgagaatttgccagaaataaatatagacttaacttacaaacagggacgattacaattcaggcccccttttgaagaaatccgggctaaatattatagagaaatgaagagattcatcggcattccaaatcagtttaagggagtgggtgaggcaggagatgaatctattttttctattatgattgatagaaatgcaagtggatttttgacgattttcagcaaagcagaagatctgtttagaagattgtcagctgttttacaccaacataaggaatggattgtaattgggcaagttgatatggaagctctggtggaaaagcatctttttactgtacatgattgggagaaaaattttaaagcattaaaaataaaggggaaagaagtagaacgacttccaagtgctgtcaaggtagattgtttaaatattaattgcaaccctgtgaagactgtgattgatgatctcatccagaagttatttgatctgcttgttctttctttgaagaagtccatacaggctcatttacatgaaattgatacatttgttactgaggctatggaagtcttaacaattatgccccagtctgtggaagaaattggtgatgcaaatctacaatatagtaagttacaagaacggaagccagagattttgcccttatttcaagaagctgaagacaaaaacagacttttacgaactgtggctggtggaggtttagaaacaattagtaatttgaaagccaagtgggataaatttgagttaatgatggaaagtcaccaacttatgattaaagaccagattgaagtgatgaaaggaaatgtgaaatcacgtcttcagatctattatcaagaactggaaaaatttaaagctcgttgggaccaactaaagcctggtgatgatgttattgaaactggccaacataatactcttgataaaagtgcaaagttaataaaagagaaaaaaattgagtttgatgatcttgaagtcacaagaaaaaagctggttgatgattgccatcattttagactggaagagcctaatttctccctggcaagtagtatctctaaagatatcgagagctgtgcccaaatttgggccttttatgaagagtttcaacaaggatttcaggaaatggccaatgaagactggatcacttttcggactaagacatacctgtttgaggaatttttgatgaactggcatgacagattaaggaaggttgaagaacattcagtgatgacagtgaaattacaatcagaggttgacaaatataaaatcgtaattcctatcttgaaatatgtgagaggggagcatctttctccagatcactggcttgacctttttcgtctccttggacttcctagggggactagtctagagaaactactgtttggtgatttgctcagagtagctgatacaattgtagccaaagctgccgaccttaaagatttaaatagtcgggcacaaggtgaagttacaatcagagaagctttacgtgaacttgatctttggggagttggagcagtgtttacattaattgattatgaagacagccaaagtcgaactatgaagctgattaaagactggaaagatatagtaaatcaggttggagataatagatgccttctccaatccttaaaggattctccttattataaaggatttgaagataaagtatcaatttgggaaagaaaacttgcagagttagatgaatacctgcagaatttaaatcatattcagagaaagtgggtgtatttggaacccattttcggccgtggagcattgccaaaagaacagacacgcttcaacagagttgatgaagattttagatcaataatgactgatatcaagaaagacaatagagtcacaacattaactactcatgctggaataagaaattctctactaacaatacttgatcagcttcaaagatgtcagaaatcattaaatgaatttttggaggaaaaacgctcagcattcccaagattttattttattggtgatgatgacttattagaaatattgggccagtctaccaacccatcagtgattcagtctcacctgaagaagctttttgctggtattaacagtgtttgctttgatgagaaatcaaaacatataactgcaatgaaatctttagagggagaagttgtaccttttaaaaataaagttcctctatcaaataatgtagagacatggttgaatgatttggccttagaaatgaagaaaactttggaacagttgttgaaggaatgtgttactactgggcgaagttctcaaggtgcagttgacccatctctgttcccttcacagattttatgcttggcggagcagattaaattcactgaagatgtagaaaatgctattaaagatcatagtcttcatcagattgaaacacaactggtgaataagttagagcaatatactaacattgatacaagttctgaggatccagggaatactgaatcgggcatcctggagcttaaacttaaagccctaattcttgacattatccataatattgatgtggtaaagcagttaaaccaaattcaggttcatacaactgaagactgggcttggaaaaaacaacttagattctatatgaaaagtgatcatacatgttgtgttcaaatggtggattctgaatttcagtatacttatgaatatcagggtaatgcttccaaactggtttatactccactgacagacaagtgctacttaactctcactcaagccatgaagatgggacttggaggaaatccttatggaccagctggaactgggaaaacggaatcagtaaaggctttaggtggacttcttggaagacaagttttagtctttaattgtgatgagggcatcgatgtgaagtcaatgggacgaatatttgttggtttggtgaagtgtggggcctggggttgttttgatgaatttaataggctggaagaatctgtactgtcagcagtttctatgcaaatccagacaattcaagatgctttgaagaatcatagaactgtatgtgaactgcttggcaaggaggtagaagtaaattctaattctggaatttttatcactatgaatcctgctggaaaaggttatggaggaagacaaaaactgcctgataatcttaaacagcttttcaggcccgtagctatgtctcatccagacaatgagcttattgcagaagttattctctattcggaaggctttaaagacgctaaagtattgagcagaaaattggtagctattttcaatctatctagggaacttttgacacctcagcaacattatgattggggtttgagagctttgaagacagttctgagaggaagtggaaatctccttagacagctaaacaaaagtggcactacacagaatgctaatgaaagtcatattgtggtacaagcactgaggcttaataccatgtcaaagtttacgtttactgattgcacccggtttgatgcactgataaaagatgtctttccgggaattgaattgaaagaagtggaatatgatgaactaagtgctgcattaaagcaggtctttgaagaggccaattatgaaattatacccaatcagatcaaaaaggctttagaattgtatgaacagttatgccagaggatgggagttgttattgttggtccaagtggtgctggaaaatcaacgctttggagaatgttaagggctgcgctttgtaaaactggcaaagtagtgaaacaatatactatgaatcccaaagctatgcctcgatatcaattattaggccatattgacatggacacaagagaatggtctgatggtgttttgacaaatagtgctcgtcaagtggttcgggaacctcaagatgtcagctcatggataatctgtgatggtgatattgaccctgaatggatagaatctctgaattctgttctggatgataatcgactgctgactatgcccagtggagaaaggattcagtttggcccaaatgttaactttgtatttgaaactcatgatttaagttgtgcatcaccagccacaatatctagaatgggaatgatctttcttagtgatgaagagacagatcttaattctctgataaaatcttggttgaggaatcagcctgctgaatatagaaataatcttgaaaattggattggagattattttgaaaaggctttacaatgggttctaaagcagaatgactatgtggtagaaacaagtttggttgggactgtgatgaatggtttgtcacatctacatggttgcagagatcatgacgaattcattattaatctcataaggggacttggtggaaatctgaatatgaagtcacgtttggaatttaccaaagaggtttttcattgggcacgagaatctcctccagactttcacaaacctatggatacctactatgactctactaggggtcgattagcaacatatgtgcttaagaagccagaagacttgactgctgatgatttcagtaacggcttaactcttccagtcattcagactcctgacatgcaacgaggtctagattatttcaaaccatggttaagttctgatactaaacagccctttattctggtaggaccagaaggatgtggcaaagggatgctgctcaggtacgcattttcacaactccggtccactcaaattgctacagttcactgtagtgcacaaaccacttctcgacatctcctgcagaaactgagccagacttgcatggtaatcagtactaatactggtcgtgtatacagaccaaaagactgtgaaagacttgttctgtacttaaaagatatcaacctacctaaacttgataaatgggggaccagtactttggtagcattcctacaacaggtattgacgtatcaaggattttatgatgaaaatttggaatgggttggtctagaaaatattcaaattgtggcttctatgtcagctggaggaagactgggaagacataaacttactaccagatttacttccatcgttcgtctttgttctatagattacccagaaagagagcagttacaaacgatttatggagcatatttggaaccagttctacataaaaatctgaagaatcattctatttggggttcttcatcaaaaatttatcttttagcaggatctatggtacaagtgtatgaacaggtgcgagccaaatttacagttgatgattatagtcactatttctttactccttgcattcttacccaatgggttcttggcttatttagatatgatttagaaggaggatcctcaaaccatccactagattatgtgttagaaattgtagcatatgaggcacggcgcttatttcgtgacaaaattgttggtgcaaaggaacttcatttatttgacatcattttaacatcagtgtttcaaggagattggggctcagacatattagacaatatgtcagatagtttctacgttacatggggagctcggcataattcaggagcaagggcagccccaggacaaccattacctccacatggaaaaccacttggaaaactaaactctactgatctcaaggatgttattaaaaagggtcttattcattatggacgagataaccagaatttagacattttacttttccacgaagtcttggagtatatgtctaggatagatagagtgctgagtttccctggaggttcacttctattagcaggacgcagtggtgtaggtcgtcggaccatcacttctttagtcagtcacatgcatggagcggtcctgttttctccaaagatttccagaggatatgaactgaagcagttcaaaaatgatctcaaacatgtgctgcaacttgcaggaattgaagcacaacaggtagttttacttcttgaggattaccagtttgtacatcctacatttttggagatgatcaatagccttttgtcttcaggtgaagttcctggactctatactcttgaagaattagagcccttgctgttaccacttaaggatcaagcttcacaagatggtttttttggaccagtcttcaattacttcacatatagaattcagcaaaacttgcatattgtcttgataatggattctgcaaattcaaacttcatgataaactgtgagagtaatccagctttgcataagaaatgccaggtgttgtggatggagggttggtccaatagcagtatgaagaaaatacctgaaatgttattcagtgaaacaggtggtggagaaaaatacaatgataaaaaacgaaaagaagaaaagaaaaaaaattcagttgatcctgattttctaaaatcatttttattaatccatgaatcttgtaaagcatatggtgctacaccaagccgatacatgacctttttacatgtgtattctgccattagtagtagcaagaaaaaggaattattaaaaagacaaagtcatttgcaggctggtgtatctaaactaaatgaagctaaagctcttgtggatgaactgaacagaaaagctggagaacaaagtgtgttacttaaaacgaagcaagatgaagcagatgctgcccttcaaatgatcacagtgtcaatgcaggatgctagtgagcaaaaaacagaacttgaaagactgaagcacagaatagcagaagaagttgttaaaattgaagaaagaaaaaataaaattgatgatgaattaaaagaagtacaacctttagtcaatgaagctaaactagcagttggaaacattaagcccgaatcactttcagaaattcgctcactacgcatgccacctgatgtaattagagatattcttgaaggagttttaaggttgatgggtatctttgatacatcttgggtgagcatgaaaagtttccttgcaaaaagaggtgtaagagaagacatagcaacctttgatgcccgaaatatttcaaaggaaataagagagagtgttgaagaacttctttttaaaaataaaggctcttttgatccaaagaatgctaagcgtgccagtactgcagctgcacctttggctgcctgggtgaaagccaatattcagtattcccatgtcttggaacgaattcatcctttggaaactgaacaggcaggattagaatcgaatctgaagaaaactgaagacagaaaaaggaaactagaggagcttcttaattctgttggtcaaaaggtatcagaactcaaagaaaaatttcagagcaggacttcagaagctgccaaacttgaggctgaagtaagcaaggcacaagaaacaatcaaagctgcagaagtcttaattaatcagcttgacagagaacataagagatggaatgcacaggttgtagagataacagaggaattagctactcttcctaaaagagctcaacttgctgctgcatttattacatatctttctgctgctcctgaatctctgagaaaaacctgtttggaagaatggaccaagtcagctggtcttgagaaatttgatctgaggagatttctttgtactgaaagtgagcagttaatttggaaaagtgaaggcctaccatcagatgacctttccatagaaaatgctcttgtaatattacagatcattggtttgaaatcatggagtcgagtgtgcccatttcttatagatccttcttcccaagctacagagtggttaaaaacacatttgaaagactcacgtttagaagttatcaatcagcaggatagtaactttatcacagctcttgaattagcagtacgttttgggaaaacccttattatacaagagatggatggtgtagaacctgttctttatccattattgagacgagatctggttgctcaaggaccacgttatgtggtacaaataggtgacaaaattattgactacaatgaagaattccgcctctttttgtcaacaagaaacccaaatccttttattccaccggatgcagcttccattgttactgaggttaactttactacaacaagaagtggattacgagggcagcttttagctttaaccattcagcatgagaaacctgatttagaagaacagaaaacaaaactattacaacaggaagaagataagaaaatacagctagccaagctcgaagaatctcttctagagacacttgccacatctcaaggcaatattttggaaaataaggatttgattgagtctttgaatcagacaaaagcaagcagtgcacttattcaagagtcacttaaagaatcttacaaactccaaatttcccttgatcaagaacgggatgcctatctccccctggctgagagtgccagcaagatgtacttcattatttctgatttgtccaaaattaataacatgtaccgttttagtttggctgcttttctccgacttttccaacgagctctacaaaacaaacaggattctgaaaatacagaacagagaatccagtcacttatcagctcattacaacatatggtatatgaatatatatgtcgttgtctatttaaggctgatcagttgatgttcgctttgcattttgttcgaggcatgcatcctgaactttttcaagaaaatgaatgggatacgtttacaggtgtggttgttggagacatgttacggaaagctgactctcaacaaaaaatacgtgatcagcttccgtcttggatagatcaggaacgaagctgggccgtggcaacattaaagattgctctccccagtctttatcagaccctctgctttgaagatgcagctctgtggcgtacttattataataattcaatgtgtgagcaagagtttccatctatccttgcaaagaaagtttccttatttcagcagattcttgtagtacaggcgctaagaccggacagattgcaaagtgccatggctctttttgcatgtaaaactctgggactgaaagaggtgtccccactgcctctaaatctcaaacgtttatacaaagagacactggaaattgaacccatcttgataattatttctccgggtgctgatccttctcaggaacttcaagaactagctaatgctgaaagaagcggagagtgttatcaccaggttgccatgggtcaaggtcaagctgatttagcaattcaaatgctaaaagaatgtgcccgcaatggagactggctctgtttgaagaacttacatcttgtggtatcttggctgccagttctggaaaaggaattgaatactcttcaacctaaagatacctttcgtctttggctcactgcagaagttcatcccaactttactcctattttactacagtcaagtctgaagataacatatgagtcacctccaggtttaaagaagaatttaatgcgtacttatgagtcttggactcctgagcaaattagcaaaaaagataatacacatcgagctcatgctctcttcagtcttgcatggtttcatgctgcatgtcaagaaagaagaaactatattcctcagggttggacaaagttttatgaattttctttatcagatcttcgggctgggtacaacattattgacagactttttgatggtgccaaagatgtacaatgggaatttgtacatggtttacttgaaaatgctatttatggaggacgtatagacaactattttgaccttagagttcttcagtcatacctgaagcagttttttaattcttcagttattgatgtattcaaccaaaggaacaagaaaagcatttttccatattccgtatctctaccacaatcctgcagcattttggactatcgtgctgtcattgagaaaattccagaggacgacaaacctagtttctttggtctgcctgccaatatcgctcgctcatctcagcgcatgatcagttctcaggttatttcacagttgaggattttgggcagatccataacagctggttccaaatttgatagagaaatctggtctaatgaactttctcctgtcctcaatctctggaagaaactaaaccagaattcaaacctaatacatcagaaagtgcctcctcctaacgatcgacaaggatctccaatactgtcattcatcattcttgaacaatttaatgctattcgtttagtacaaagtgtccaccagtctcttgctgctctcagcaaagtcatcagaggaactactttactgagttcagaagtacaaaaattggcaagtgctttattaaaccaaaagtgtcctctcgcatggcagagcaagtgggaaggcccagaagatcccttacaatacctgagaggtcttgttgcccgtgcccttgcaatacagaactgggtagataaagctgaaaaacaggctcttctctctgaaacacttgacctatcagaacttttccatccagacacatttcttaatgctcttcgccaggaaactgcaagggcagtgggtcgttctgtggatagccttaaatttgtagcctcatggaaaggtcgactgcaagaagcaaagctacaaattaagatcagtggcttgttactagaaggatgtagttttgatggaaatcaactttctgaaaatcagcttgattctcccagcgtgtcatcagtgctcccttgttttatgggctggattccacaggatgcatgtggtccatattctccggatgagtgcatctctttgcctgtttacacaagtgctgaaagggatcgtgtggttaccaatattgatgttccatgtgggggcaaccaagaccagtggattcagtgtggagcagctctattcctaaaaaatcagtag

SEQ ID NO: 9043 - DNA, 3305 bp, Homo sapiens
ggttaaaaacacatttgaaagactcacgtttagaagttatcaatcagcaggatagtaactttatcacagctcttgaattagcagtacgttttgggaaaacccttattatacaagagatggatggtgtagaacctgttctttatccattattgagacgagatctggttgctcaaggaccacgttatgtggtacaaataggtgacaaaattattgactacaatgaagaattccgcctctttttgtcaacaagaaacccaaatccttttattccaccggatgcagcttccattgttactgaggttaactttactacaacaagaagtggattacgagggcagcttttagctttaaccattcagcatgagaaacctgatttagaagaacagaaaacaaaactattacaacaggaagaagataagaaaatacagctagccaagctcgaagaatctcttctagagacacttgccacatctcaaggcaatattttggaaaataaggatttgattgagtctttgaatcagacaaaagcaagcagtgcacttattcaagagtcacttaaagaatcttacaaactccaaatttcccttgatcaagaacgggatgcctatctccccctggctgagagtgccagcaagatgtacttcattatttctgatttgtccaaaattaataacatgtaccgttttagtttggctgcttttctccgacttttccaacgagctctacaaaacaaacaggattctgaaaatacagaacagagaatccagtcacttatcagctcattacaacatatggtatatgaatatatatgtcgttgtctatttaaggctgatcagttgatgttcgctttgcattttgttcgaggcatgcatcctgaactttttcaagaaaatgaatgggatacgtttacaggtgtggttgttggagacatgttacggaaagctgactctcaacaaaaaatacgtgatcagcttccgtcttggatagatcaggaacgaagctgggccgtggcaacattaaagattgctctccccagtctttatcagaccctctgctttgaagatgcagctctgtggcgtacttattataataattcaatgtgtgagcaagagtttccatctatccttgcaaagaaagtttccttatttcagcagattcttgtagtacaggcgctaagaccggacagattgcaaagtgccatggctctttttgcatgtaaaactctgggactgaaagaggtgtccccactgcctctaaatctcaaacgtttatacaaagagacactggaaattgaacccatcttgataattatttctccgggtgctgatccttctcaggaacttcaagaactagctaatgctgaaagaagcggagagtgttatcaccaggttgccatgggtcaaggtcaagctgatttagcaattcaaatgctaaaagaatgtgcccgcaatggagactggctctgtttgaagaacttacatcttgtggtatcttggctgccagttctggaaaaggaattgaatactcttcaacctaaagatacctttcgtctttggctcactgcagaagttcatcccaactttactcctattttactacagtcaagtctgaagataacatatgagtcacctccaggtttaaagaagaatttaatgcgtacttatgagtcttggactcctgagcaaattagcaaaaaagataatacacatcgagctcatgctctcttcagtcttgcatggtttcatgctgcatgtcaagaaagaagaaactatattcctcagggttggacaaagttttatgaattttctttatcagatcttcgggctgggtacaacattattgacagactttttgatggtgccaaagatgtacaatgggaatttgtacatggtttacttgaaaatgctatttatggaggacgtatagacaactattttgaccttagagttcttcagtcatacctgaagcagttttttaattcttcagttattgatgtattcaaccaaaggaacaagaaaagcatttttccatattccgtatctctaccacaatcctgcagcattttggactatcgtgctgtcattgagaaaattccagaggacgacaaacctagtttctttggtctgcctgccaatatcgctcgctcatctcagcgcatgatcagttctcaggttatttcacagttgaggattttgggcagatccataacagctggttccaaatttgatagagaaatctggtctaatgaactttctcctgtcctcaatctctggaagaaactaaaccagaattcaaacctaatacatcagaaagtgcctcctcctaacgatcgacaaggatctccaatactgtcattcatcattcttgaacaatttaatgctattcgtttagtacaaagtgtccaccagtctcttgctgctctcagcaaagtcatcagaggaactactttactgagttcagaagtacaaaaattggcaagtgctttattaaaccaaaagtgtcctctcgcatggcagagcaagtgggaaggcccagaagatcccttacaatacctgagaggtcttgttgcccgtgcccttgcaatacagaactgggtagataaagctgaaaaacaggctcttctctctgaaacacttgacctatcagaacttttccatccagacacatttcttaatgctcttcgccaggaaactgcaagggcagtgggtcgttctgtggatagccttaaatttgtagcctcatggaaaggtcgactgcaagaagcaaagctacaaattaagatcagtggcttgttactagaaggatgtagttttgatggaaatcaactttctgaaaatcagcttgattctcccagcgtgtcatcagtgctcccttgttttatgggctggattccacaggacttattatgaaagtaatgatgttatcactatattgttgaaaaatcaggatgcatgtggtccatattctccggatgagtgcatctctttgcctgtttacacaagtgctgaaagggatcgtgtggttaccaatattgatgttccatgtgggggcaaccaagaccagtggattcagtgtggagcagctctattcctaaaaaatcagtagaatctaatgacaacaaaagccatcttcacaaaagggaacattgattctttaagctttaaatcaaacatgtggtcagtctacatttgaaatgttagttcaaaatattaacatatagttatgttgttgatgtcactgaaattttaatgtgtaaaagcagcactgtgcatcttttaaagtaataaattaatggagttattgtt

SEQ ID NO: 9044 - DNA, 720 bp, Homo sapiens
ggcgggagcagggcggggcctgagcactaggcggcggcggctggcgtggggctgcttagatgcgccacggtttcggtagcgacggtatctctagccgggcctgagctgtgctagcacctcccccaggagaccgttgcagtcggccagcccccttctccacggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 9045 - DNA, 697 bp, Homo sapiens
ggcggctggcgtggggctgcttagatgcgccacggtttcggtagcgacggtatctctagccgggcctgagctgtgctagcacctcccccaggagaccgttgcagtcggccagcccccttctccacggccttgcccactaggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatg

SEQ ID NO: 9046 - DNA, 814 bp, Homo sapiens
gctgacagggagagcctggggccgggccgtgtggatgccatccccgagcgcggttcgcgctcggctgaggcgctggacaagtggcttgggctcccgcgcctcagtttctctctgtggcgccgcctacctcacagacttgtgagcactcactgacgtgggtagcgcccagggcctgcggggcgcaggagagctggagtcaggcggagaccgcaggctgaccccgcagcggccgggctgtcgcggcccccacctcaggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtg

SEQ ID NO: 9047 - DNA, 662 bp, Homo sapiens
gatgccatccccgagcgcggttcgcgctcggctgaggcgctggacaagtggcttgggctcccgcgcctcagtttctctctgtggcgccgcctacctcacagacttgtgagcactcactgacgtgggtagcgcccagggcctgcggggcgcaggagagctggagtcaggcggagaccgcaggctgaccccgcagcggccgggctgtcgcggcccccacctcagagccactggtggccgcagaagacagtccacgtgtcttaaccagacttacaagactccaaagatgggtgccttgtatcaagcaggtgctcaacaaatgtctgctgaaaaaatgatgcagggtgcggtggttcacgcaggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagt

SEQ ID NO: 9048 - DNA, 794 bp, Homo sapiens
gggagagcctggggccgggccgtgtggatgccatccccgagcgcggttcgcgctcggctgaggcgctggacaagtggcttgggctcccgcgcctcagtttctctctgtggcgccgcctacctcacagacttgtgagcactcactgacgtgggtagcgcccagggcctgcggggcgcaggagagctggagtcaggcggagaccgcaggctgaccccgcagcggccgggctgtcgcggcccccacctcagagccactggtggccgcagaagacagtccacgtgtcttaaccagacttacaagactccaaagatgggtgccttgtatcaagcaggtgctcaacaaatgtctgctgaaaaaatgatgcagggtgcggtggttcacgcagtaaagatggggtttcaccatgttagccaggatggtcttgatctcctgacctcgtgatccgcctgcctcggcctcccaaagtgctgggattacaggcgtgagccaccacacccggccatataaggaaagactgcctcacctgagcaagaagcttcaccctggacaaaaaccccggggctcaacactcccaaatccacccggatccccatccccaaccccttaaaggatgtccgcattgcttggcagagaccccactcttggggataatcccttaattcgtaaccatgtgcgaccgaaaggccgtgatcaaaaatgcggacatgtcggaagagatgcaacaggactcggtggagtgcgctactcaggcgctggagaaatacaacatagagaaggacattgcggctcatatc

SEQ ID NO: 9049 - DNA, 719 bp, Homo sapiens
agatgcgccacggtttcggtagcgacggtatctctagccgggcctgagctgtgctagcacctcccccaggagaccgttgcagtcggccagcccccttctccacggtgagaaactcggggggccagggggtgtcctcgctgccttatttcgccccactccggacttagccctccgcgtagcccgcgcttcctgagaagtggggtggggggcgtcgtcccgtggtggcgccggccggggtgggggcagttagtgcctggggggcgcggcccaactcaaccccttaccccaggccttgcccactaggtaaccatgtgcgaccgaaaggccgtgatcaaaaatgcggacatgtcggaagagatgcaacaggactcggtggagtgcgctactcaggcgctggagaaatacaacatagagaaggacattgcggctcatatcaagaaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagg

SEQ ID NO: 9050 - DNA, 1522 bp, Homo sapiens
agcggcagagcggagcggagctgtgaggcgccagtgcggagcgggcgggcgggcgggcggcgtgaggcggagcgcgggcggccggcgaaactccaagggcggaccgcggcagggagcgatcggcctcgggctgcgggagccggagaccgcggcggcggcggctgctgcagctgcaggaggagcccagggaacaccgcccctgcctgtgctctgcctcgggccatcgctcctccccagggcccagtgcggactcgcctccgtgaagtgtcacaccatgtctgaccggaaggcagtgatcaagaacgcagacatgtctgaggacatgcaacaggatgccgttgactgcgccacgcaggccatggagaagtacaatatagagaaggacattgctgcctatatcaagaaggaatttgacaagaaatataaccctacctggcattgtatcgtgggccgaaattttggcagctacgtcacacacgagacaaagcacttcatctatttttacttgggtcaagttgcaatcctcctcttcaagtcaggctaggtggccatggtgaaggtgtcagtggcggcggcagcgatggcaagcaggcggcgttgctgggactgttttgcactggagccagcatcaggatgtcctctccaatggctgtgctactgcatggactgtatactcgatttcatgtgtatgtcgcagtaaacaaaaccaaacctctttctgtttagttgcctgggggaagaaggctgctttatgtttatttttcaagactttaaaaatattttttggttgtattgcactaggaaatctctcccacctctcccttttctctttctttccctatacaaaataaaaggcccaccatagagactaggcggccgaaagactaggagggctgaggaaaagaaataggtctctggaggtggaactaaaactgtgcagctgcctcttcctggcggtggatgctgctttgggagggccagggaggctgcagggggacagtgttgggattgtcaaggaaaaaggggtaggaaggaaggtggagggattgatctagtaccagggagaatattccactgaactgtgattctatggcttggggcggagggtggggtggggatgccttctttaggggccctgagatgtgtttgtctgtggtgtgtgggagtggggagcagatttgtcttgctgtctttgtcagaatttctaagtaagggctgtgtctttgtggattaccttcttttgttcttcctgccagagatcatgacaggaggatgctggggtaggattagcttgaatcttttttttctttacatttttctcctgtctgctccctgcttagccctcagtttcctcattcctctggagttctcttagagcagcccctgttgttagttggctggcaagggaatttctggtgactgtagttccttagttaggtcttagcaatcaaaccaaattgatgtctcccttgactcttctgtgtatatgtgtgaatatgtgtgtatatgtgtgtgtatgtgt

SEQ ID NO: 9051 - DNA, 1464 bp, Homo sapiens
ccggatcggtcggaaatggcagaggtggaggagacactgaagcgactgcagagccagaagggagtgcagggaatcatcgtcgtgaacacagaaggaggctgggagcccttgggacactgtggagacaggagcaggccccctgctcagggctgcccctgatcagttgggtggcctgaggcaactcctttccccgcttcagccctcaactgcctcgagtcctgtgatggtccagggaatctcttttgggcacttcttgctctaagacctgaaagacttttgtcactaagagagaaactgtcttctgggactggacattttgactccaaggagacaaccccaggggccaacagccccagctgtgacccccaggcttccacatgaactcacaaaggagaggccctcattcttgccttaaaactgcccctaaagccaagccttttcactgggaagccctagctgcttaccttttggatactagtgagtgctgcttttttgtatactcatggggctgattgcaccatagctgagaacgtggaatgcagaatgagcccacctggctttgaatctgggccctacttaacttatcagctatgtggttttgggcataagccactttctctgttaagttttctcatttgtaaaatgtgggtcataattctgccttcctctaggggaagcttttagaatagtgcctggcatgaaatgcctatgaatgtctcagttagtgtgtgtgtgtctttaacttgcgtcccattctcagggcccccacatcagtgtctcgtttacatctcacacagtgaccctgcgaggcaagggtttgcccagtttgcagatgagaaacccaaagctgagagaggtgtggggaaccgcccaaggtcacccagctgtgaatgaacgtggtcagaacacagaatctgagttggtcacacttcccactgatccatggggcctttaagccctctggaagcttccattaaagatgattatttgaggataattgtattgggatgcctatgatcttatctagggttttcctacccatccccaacattcagctcagctgcctctttcttgaggacaccctcactgatcaccccagcccagccagagtggttgctcctgctcctgcccctgaacctatgacatacccaagtcccaatactttcgagccatctgccactgccttttgacatctctgccttggctagattcaaatggtgtttcataataaaagtctgagtttaagcagctttaccgaaaacgcaagggaagtttcattccatttatacttctccagaccccctgccatcctctgctgctacccacacaggcagaataaaaggcttaaatgtgtaagtcccatgaaggcaaagattggtctcttgtgttcactgctgtctgtagtacttaggatggtgttggcccagagttggtgtttgattaaagtatctgttgaatttttta

SEQ ID NO: 9052 - DNA, 675 bp, Homo sapiens
cacaggactcgctaagtgttcgctacgcggggctaccggatcggtcggaaatggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccagataaagactatttcctgattgtgattcagaatccaaccgaataagccactctcttggctccctgtgtcattccttaatttaatgccccccaagaatgttaatgtcaatcatgtcagtggactagcacatggcagtcgcttggaacccactcacaccaatccagtgaccgtgtgtgggctggcggctcttctcccccaccaacggaacccctgtgtgcaccaaccttccccagagctccggagcgccctctcctcacttccaggttttggagcaagagcttgcaggaagcccgcacccagcttccttctgaccttcagttcactttgtcgcccttggagaaagctgtttttctttaactaaaaataaccaaaatgctta

SEQ ID NO: 9053 - DNA, 1072 bp, Homo sapiens
gttcgctacgcggggctaccggatcggtcggaaatggcagaggtggaggagacactgaagcgactgcagagccagaagggagtgcagggaatcatcgtcgtgaacacagaaggcattcccatcaagagcaccatggacaaccccaccaccacccagtatgccagcctcatgcacagcttcatcctgaaggcacggagcaccgtgcgtgacatcgacccccagaacgatctcaccttccttcgaattcgctccaagaaaaatgaaattatggttgcaccaggtaaggggtcttctacctccccatgtaggaacagacctcatggcacattctctgtggctcatcaggagtcctggcacagtggtgtctccagaggatccaagcagggcccgaggagttgaaggaattgggttgttgcctcactgcctagccagcctccagctggtgtcccatagcagatcctcccagggaccggccccagagggtaaccccagtctcctgagatagacagacacgtgagcatcatgtgtgtctccccttccttgataggagaaaactcaaaggcatttgggacatagaggagggtgtggccaggcctgtctggggctgtctgcaaaagcttcccagaagaggggacactggagctgaatcttaagggcaccaggaagcagtgtgagcaaggcggaggggcggaaagccacgtttggaagaatattcagtgattcttctccaaaatgtaaagcaaaagtactgtatcattttatccttgaaaacatgttctctgcccacttgtaaaggccaggcctgtctttaggccccttacagccagcttttcctgccgcacgggagcagattgctttgtttcctttacgcgaggtgcttgccttgcatttgggggctctgtggtgcaaccaaggcctgtgtttagtccttaggatcattctcagggtgaggagatgctcattctgggaggagcccacaaggatgggagcacaggagcgagcaacagagccacatctcctgcccggctccctcgctctcactcatggactggggtggcaggcagagcctcca

SEQ ID NO: 9054 - DNA, 497 bp, Homo sapiens
cagccctgacgcttccgtggggccacttccttttttgtctcctagcaacggcgggtagcgttgttgacatcccgggaggctgtgccgccggcctgagcccagagtttcgcggcctccgcgatggcagaggtggaggaaaccttaaagaggatccagagtcataaaggggttattggaactatggttgtaaatgcagaaggtattcccatccgaacaaccttggacaactcaacaactgttcaatatgcaggccttcttcatcacctgacaatgaaagccaaaagcacagttcgtgatattgatcctcagaacgacctgacttttcttaggatcagatcaaagaaacatgaaatcatggtagctccagataaggaatatcttctgatcgtcattcagaatccatgtgaatagacctgcgatggccaaggctgtttaagcgacactgggttggaaacacttggctctctcatgagtattaaaattctatttcaatctaa

SEQ ID NO: 9055 - DNA, 512 bp, Homo sapiens
atcccgggaggctgtgccgccggcctgagcccagagtttcgcggcctccgcgatggcagaggtggaggaaaccttaaagaggatccagagtcataaaggggttattggaactatggttgtaaatgcagaagatccacgctttgtgaccttcaagtatgcaagacagctgactgccttccagagaaaaagtggccaacaaatcacaataaaagattagcaaggtattcccatccgaacaaccttggacaactcaacaactgttcaatatgcaggccttcttcatcacctgacaatgaaagccaaaagcacagttcgtgatattgatcctcagaacgacctgacttttcttaggatcagatcaaagaaacatgaaatcatggtagctccagataaggaatatcttctgatcgtcattcagaatccatgtgaatagacctgcgatggccaaggctgtttaagcgacactgggttggaaacacttggctctctcatgagtattaaaattctatttc

SEQ ID NO: 9056 - DNA, 1036 bp, Homo sapiens
gtgcgtcctctggagaagtgcgcgcgtgtaagtgtggcgagtgtggccaagggtgccggaggcagggttcgggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctgggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaacca

SEQ ID NO: 9057 - DNA, 1078 bp, Homo sapiens
cccgggagccctggaggcgcagccccaccccggccggcgcggctcgctcccacgcccccgccgcggcctcgctggagcggacggactgagtcagagggggcgccagcgctgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctgggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaacca

SEQ ID NO: 9058 - DNA, 1417 bp, Homo sapiens
agcactggaggaagggaaccctccaccctgagatctctgtctctatcctatcctgtccctggccttctgaggcaagcggggccaattaaggggaaaacgtacctcctccatttgtgctgaaccaatccctccaacccctctcaggagggcatgatatggagagttgggcattggctgtgttccctgaatacagagtatctctcttgtggtgcctggaactggcatcccctttgtggagcttagggcaagccccgcctctgcatgagacttggtttgtgggacacacttggtttcagggaaggggaaagaggtcaccaagggcagaggtgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctgggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaacca

SEQ ID NO: 9059 - DNA, 1537 bp, Homo sapiens
tagcgttgtgacctgggcggcagctctaagagcctttcccgggaatcggcgtcagcgcctcgctcctccgccgccagcccgcggccgcacggtctccccagacttccgtggccctgccttggccagtcggggttgggtccctctccacctctgtggcgcccgtggagctggccagggtctgggatacgctgggtgcagatgaggtggggaaggcagtctgcggaggatgacgtctgatcctcaagctagaaactcccttgcctctggtgatgggctcagagcagaacgccgggaaggagatgagcgaatgggaatgaatgcaccgacctgggctggcccatagcctcagtgctctggcagggtctcagcttctcagccctaggggtcaggaggcctgctctgaactggacccagaacccgcctttccaattgctcctcactgactaatggggagataagtcagtgagatgtgtcccaggagggggacgcataaagagctgttggagttcaaaggaaagatggtagtctcctaaatagctcaccttcacaagcagggtcttgtatttgaggcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctgggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaacca

SEQ ID NO: 9060 - DNA, 1207 bp, Homo sapiens
ctcgttcccggctcccagggcccgtcggtcccccgggagccctggaggcgcagccccaccccggccggcgcggctcgctcccacgcccccgccgcggcctcgctggagcggacggactgagtcagagggggcgccagcgctgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggtatgcccctctgctttggggacttcagtgccagtcagccagagccggatgtcaggctctgaaacgaggctacaaggctgggctggggaagtacacaaggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaacca

SEQ ID NO: 9061 - DNA, 1481 bp, Homo sapiens
cgagtgtggccaagggtgccggaggcagggttcgggtgcgtagtcgttgcgtgggcgctgcccaaaaggcgcagagcatcaagtgtgcgtgggcagaaccggcgcgggcgcccgccgcgggtctgcgcggggcgggggcgcagcaagtgcatccgagcgagcggagactagcgcaccggcgtcggtggcgagggtggtgcagaggagtccggctgggcggagggaggaaggatgggtgcgggtaactttttgaccgccttggaagtaccagtagccgcgctcgcaggggctgcctccgaccgccgggcgagctgcgagcgagtgagcccgccaccgcccctcccccacttccgcctcccgcctcttcctcgttcccggctcccagggcccgtgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctgggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaacca

SEQ ID NO: 9062 - DNA, 1202 bp, Homo sapiens
agccgggcgagtcccagggcaggggtcctccgccgccttgcacctgccctgctgggcggcaccgggtcagtgccctgccccctcctgcgggtcccaactctctctttcccatcgtgcgtcctctggagaagtgcgcgcgtgagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggtatgcccctctgctttggggacttcagtgccagtcagccagagccggatgtcaggctctgaaacgaggctacaaggctgggctggggaagtacacaaggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaacca

SEQ ID NO: 9063 - DNA, 1118 bp, Homo sapiens
caggaatcaggggcagccgggcgagtcccagggcaggggtcctccgccgccttgcacctgccctgctgggcggcaccgggtcagtgccctgccccctcctgcgggtcccaactctctctttcccatcgtgcgtcctctggagaagtgcgcgcgtgagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctgggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaacca

SEQ ID NO: 9064 - DNA, 1233 bp, Homo sapiens
acacttggtttcagggaaggggaaagaggtcaccaagggcagaggtgtccaggccggagccaggggccccactgttgggatgctggctgcagtggggcgccccaagcccaggtcccctctgtcttctctttcgactttgcagctgtacttgttttgctcctctacccgcaggagctgacatggacccaaatcctcgggccgccctggagcgccagcagctccgccttcgggagcggcaaaaattcttcgaggacattttacagccagagacagagtttgtctttcctctgtcccatctgcatctcgagtcgcagagaccccccataggtagtatctcatccatggaagtgaatgtggacacactggagcaagtagaacttattgaccttggggacccggatgcagcagatgtgttcttgccttgcgaagatcctccaccaaccccccagtcgtctggtatgcccctctgctttggggacttcagtgccagtcagccagagccggatgtcaggctctgaaacgaggctacaaggctgggctggggaagtacacaaggatggacaaccatttggaggagctgagcctgccggtgcctacatcagacaggaccacatctaggacctcctcctcctcctcctccgactcctccaccaacctgcatagcccaaatccaagtgatgatggagcagatacgcccttggcacagtcggatgaagaggaggaaaggggtgatggaggggcagagcctggagcctgcagctagcagtgggcccctgcctacagactgaccacgctggctattctccacatgagaccacaggcccagccagagcctgtcgggagaagaccagactctttacttgcagtaggcaccagaggtgggaaggatggtgggattgtgtacctttctaagaattaaccctctcctgctttactgctaattttttcctgctgcaaccctcccaccagtttttggcttactcctgagatatgatttgcaaatgaggagagagaagatgaggttggacaagatgccactgcttttcttagcactcttccctcccctaaaccatcccgtagtcttctaatacagtctctcagacaagtgtctctagatggatgtgaactccttaactcatcaagtaaggtggtactcaagccatgctgcctccttacatcctttttggaacagagcacggtataaataataaactaataataatatgccaacca

SEQ ID NO: 9065 - DNA, 16742 bp, Homo sapiens
atggctttaggctagattcttttgaatagttatcagcatattatttgctgtgtgttgcatatgcatgttgaagcatatttaaggagccactaaaagctgtaatattcagctgccacttttcaccgttagaagtagagctttttccagacctcctaccttttagtctactttgaaaggtgaaagaaagaacatcgtttcaggaataaaaatgcacagtagtagttatagttaccgtagcagtgattctgtgtttagtaacactaccagcactcgaaccagtcttgattcaaatgaaaatcttctcttggttcattgtggtccaacactgatcaactcttgcattagcttcggcagtgaatcctttgatggacacaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagaagtcactggaagaagaaaagaaagaacatgttgaaaaagccaaagaattgcaaaaatgggtatcaaatatcagcaagacattgaaagatgcagagaaggctggaaaacctcccttctctaagcaaaagatttccagtgaggaaatatcaaccaagaaggaacaattatcggaagcacttcaaactatacagctttttttggcaaaacatggagacaaaatgacagatgaagaaagaaatgaattggaaaaacaagtgaaaactcttcaggaaagttataatttattattcagtgaatctctgaaacagctacaagaatcacaaacctcaggagatgtaaaggtagaggagaagattgtagcagagcgtcagcaggagtataaagagaaactccaagggatatgtgatcttcttacccaaactgaaaaccgcctaattggtcaccaagaagccttcatgattggagatggcacagttgagttaaagaaatatcagtccaagcaagaggaattacagaaagatatgcaaggaagtgcacaggcattggctgaagtagtgaaaaacacagagaacttcttaaaagagaatggtgaaaagctgtcacaggaagataaggctttgattgaacagaaacttaatgaagctaagataaagtgtgaacagcttaatttaaaagcagaacagtctaaaaaggagctggataaagttgtgacaacagcaatcaaggaagaaactgaaaaggtagcagcagtgaagcagctggaagagagcaaaaccaaaatagaaaaccttttggactggttgtcaaatgttgacaaagactcagaaagggcagggacaaaacacaaacaggtaatcgaacagaacgggacccattttcaagaaggtgatggcaagtcagcaattggagaagaggatgaagttaatggtaacctgttggagactgatgttgatgggcaagttggaaccactcaggagaatctgaatcagcaatatcagaaagttaaggcccaacacgagaagatcatctctcagcaccaagcagtgatcatagccactcagtctgcacaagtgttgcttgagaaacagggtcagtatctctctcctgaagaaaaagagaaactgcaaaagaacatgaaggaactgaaagtgcattatgaaactgcactggctgagtcagagaagaaaatgaagttaactcactctctgcaggaagaattagaaaagtttgatgctgactataccgagtttgagcactggctacagcagtcagaacaagaacttgaaaacctggaggcaggtgcagatgacatcaatggtttaatgaccaaattgaagaggcagaagagtttctcagaagacgttatttctcacaaaggtgacttgagatacatcacaatttctggaaacagagtgttggaagctgccaaatcttgcagcaagagagacggtggcaaggttgatacttctgcaacccacagagaagtgcagcgcaagttggatcatgctactgatcggttcaggtctctctactctaagtgcaatgttcttggaaataatcttaaagatctggtggataaatatcaacactatgaagatgcttcatgtggacttcttgctggactccaggcctgtgaggccacagcgagcaaacacttatctgaacctattgcggtggaccccaaaaatcttcaaaggcaattagaagagaccaaggctttgcaaggacagatatcaagtcagcaggttgctgtagagaaactgaagaaaacggctgaagtgcttttagatgccaggggatctttacttccagccaagaatgatatccagaaaacacttgatgacattgttgggagatatgaggatctgtccaagtctgttaatgaacgaaatgaaaaactccagataaccttgacccgttcactgagtgtgcaggatggcttggatgaaatgctggactggatgggaaatgtggaaagttctctgaaagaacaaggtcaagtgcctttaaactctactgctcttcaggatattatcagtaaaaacattatgttggaacaggatattgcaggtcgtcagagcagtataaatgccatgaatgaaaaagtgaagaaatttatggaaacaacagatccatccactgcatcctcactgcaagccaaaatgaaagacttgtctgctcggttttcagaagcaagtcataaacacaaagaaactcttgccaaaatggaggagctaaaaaccaaagtagaactgtttgagaacctctcagaaaagctccagacatttttagaaacaaaaactcaggctcttactgaagtagatgtgccaggaaaagatgttactgaattgtctcagtatatgcaggaatcaacttctgaatttttagaacacaagaaacatcttgaagttttgcatagtctcttgaaggagatatccagccatggcttaccaagtgataaggctttggtccttgaaaaaacaaataatttgtcaaagaaattcaaggaaatggaggataccatcaaagaaaaaaaagaagctgtaacttcttgtcaagaacagttggatgctttccaagttcttgttaaatcattgaagtcatggataaaagaaacaacaaaaaaagttcccattgtacagccttcttttggtgcagaggatttaggaaaatctttggaagacactaagaaattacaagaaaagtggagtttaaaaacaccagagattcagaaagtaaacaacagtgggatctcactatgtaacttaataagtgctgtgaccacccctgcaaaggcaatagcagcagttaaatcaggtggagcagtattaaatggtgaaggaacagccacaaatactgaggaattttgggcaaataaaggtttaacatccattaaaaaggacatgactgacataagtcatggttatgaagatcttggcctcttactcaaggacaaaatagcggaactgaacactaaactctccaaattgcaaaaggctcaggaagaatcaagtgcaatgatgcagtggttacagaaaatgaacaaaactgcaacaaaatggcagcagacacctgcacctacagatactgaagctgtgaagactcaagttgagcagaataagtcgtttgaggcagaactgaagcagaatgtaaacaaagtacaggagttgaaagacaaattgacagagctgttggaggagaacccagatactcctgaggcccccagatggaaacagatgttgacagaaatagattctaagtggcaagaactcaatcaattaacaattgatagacaacaaaaactggaagaatcctccaataatctaacccagttccagactgtagaggcccaattgaaacagtggcttgtggaaaaagaacttatggtcagtgttcttgggcccttgtcaattgacccaaatatgctaaacacacaaaggcagcaggtgcagattttgctgcaagaattcgccactcggaaacctcaatatgaacagctgacagcagctggtcagggcattctgagcaggcctggagaagacccttctttacgtgggattgtgaaagagcaactggcagctgtgacccaaaaatgggatagcctaacagggcaattgagtgacagatgtgactggattgaccaagccattgttaaaagcacacagtatcaaagcctgctgagaagcctttctgataaactgagtgacttggataataaactcagcagcagtctggctgtgagcacgcaccctgatgctatgaaccaacagttggaaacagcccaaaaaatgaagcaggagatacagcaggaaaagaagcagataaaagtggcccaggcactctgtgaggatttgtcagcactggttaaagaagagtacttgaaagcagaacttagtaggcaactagaaggcatcttaaaatcatttaaggatgttgaacagaaagcagagaatcatgtccagcaccttcagtcggcctgtgcaagctctcatcaatttcagcaaatgtctagagattttcaggcttggctggatacaaagaaagaagagcaaaacaaatctcatccaatatctgccaaactcgatgtcttggagtcattaattaaagatcataaagactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagcaggtgaaagaaagagaaaacaagttaaaagagtcattggaaaaagcccttaagtataaagagcaagtagagactctctggccatggatagacaaatgccaaaacaacctggaggaaataaaattttgcttggatcctgctgaaggagagaattctattgccaagttaaagtctctgcagaaggaaatggaccaacactttggtatggtagaattactgaacaacacagccaatagcttgctcagtgtctgtgagatagataaagaagttgttacagatgagaataagtcactgatccagaaggtggacatggtcactgaacaacttcacagtaagaaattctgtctggagaacatgactcagaagtttaaagaatttcaagaagtttccaaagaatctaaaaggcagcttcagtgtgcaaaggagcagctagatatccatgattcgctgggatcccaggcttacagtaacaaatacctgaccatgttgcaaactcagcagaaatcacttcaggccttgaagcatcaggtagatttggctaaaagacttgcacaggaccttgtggtagaggcctcagactcaaagggaacctctgatgttttattacaagtggaaaccatagctcaagagcatagtacactaagtcagcaggttgatgaaaagtgttctttcttagaaaccaagcttcagggcattgggcatttccagaataccattcgagaaatgttttctcagttcgcagagtttgatgatgaactggatagcatggctccagtggggagagatgcagaaacattgcaaaagcaaaaggaaactataaaagcctttctaaagaaactagaagccctcatggcaagcaatgacaatgccaataaaacctgcaagatgatgttagccacagaagaaacctctcctgaccttgttggaatcaaaagggacttggaggccttaagcaaacaatgcaacaagttactggaccgagcccaagccagagaagagcaggttgaagggacaattaagcgccttgaagaattttacagcaaattgaaagaattttctattctgctccagaaagccgaagaacatgaagagtcacaaggtcctgttggtatggaaacggagacaattaatcagcagcttaacatgttcaaggtattccagaaagaagagattgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagccttagaagatgacatcatcaatcacaataaacatttacaccaggctgttagcattggccagtccttaaaggttttgagctccagggaggataaagatatggtgcagagtaaattagacttctctcaagtatggtacattgagattcaagagaaaagtcacagcaggtctgagctcctccagcaggccttatgtaatgctaagatttttggggaagatgaagttgaactgatgaactggctgaatgaagtgcatgacaaactgagcaagctctcagtccaggattacagcactgaggggctatggaagcagcagtctgaacttcgggttctgcaagaggacatcttactcaggaaacaaaatgtagatcaggctttactaaatggtttagaactacttaaacaaaccacaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcagtttgaccaagcagctgatgctgagttatcctggattactgaaacagaaaaaaaattgatgtctctgggtgacatcaggcttgagcaagaccagacttctgctcagcttcaagttcaaaagacattcaccatggagattttgagacacaaggatattattgatgaccttgttaaatctgggcataaaatcatgaccgcatgcagtgaagaggaaaagcaatcaatgaagaaaaaactggacaaggtactgaagaactatgataccatctgccagattaattcagaaaggtatctgcagctggaacgggcacagtccctggttaaccaattctgggaaacatatgaagaactttggccatggctgacagaaacacaatcaatcatctctcagcttcccgccccagcccttgaatatgaaactctaaggcagcagcaggaagaacatcggcaactgcgtgagttgatagctgaacacaagcctcatatagataagatgaacaaaactgggccacagttactggaattgagccctggggaaggcttttctatccaagagaagtatgtggcagccgacaccctttacagtcaaattaaagaagatgtcaaaaagcgtgctgtggcactggatgaagccatttctcaatcaactcagttccatgacaagatagatcagatccttgagagcctggaacgcatcgtggaacgtctgaggcagccaccctctatctctgcagaggttgagaagatcaaggaacagatcagtgaaaataagaatgtgtcagtagacatggaaaagctacagccgttgtatgaaactcttaaacagaggggagaggaaatgattgctagatctggggggactgataaagacatatctgccaaagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagagaccataagggaagaaatagatggactacaggaggagctggatatagttattaacctaggttctgaactcattgcggcatgtggggagcctgataaacccattgtcaagaagagtatagatgagttaaattcagcatgggattctctaaataaagcttggaaagaccggattgacaaacttgaggaggcaatgcaggctgccgttcagtaccaggatggactgcaggcggtatttgactgggtagatattgcaggtggtaaattagcttcaatgtctccaattggaacagatctcgaaactgtcaagcagcagattgaagagctaaagcaatttaagtctgaggcctatcaacagcagatagaaatggaaagactgaatcatcaagcagagcttttgctaaagaaagtaacagaagagagtgacaaacacactgttcaagacccattaatggaactgaaattgatatgggatagcctggaggagagaatcatcaacagacagcataaactggagggtgctctattagccttgggtcagttccaacatgccctggatgagctcctggcatggctgacacacaccgagggcttgctaagtgagcagaaacctgttggaggagaccctaaagccattgaaattgaacttgccaagcatcatgtgctccaaaatgatgtattagcccatcagtccacagtggaagccgttaataaagcaggaaatgatctaattgaatcaagtgcaggagaagaagcaagcaaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatggaa

SEQ ID NO: 9066 - DNA, 23715 bp, Homo sapiens
atggcgggttacctctcccctgctgcttacctgtacgtggaggagcaggagtatctccaggcctacgaggatgtcctggagaggtacaaagatgaacgggacaaagttcagaagaaaacatttacaaaatggataaatcagcatctcatgaaggttcgaaaacatgtgaatgatctctatgaagacttaagggatggacacaatttgatttctcttttagaggttctttcaggagataccttgcccagagaaaaaggtcggatgcgttttcacagactacagaatgtacaaattgcacttgactatttgaaaagacgccaggtgaaattagtgaatattagaaatgatgacataacagatggaaatcccaaattgactttgggattaatctggacaataattttgcactttcagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggccggacctgatagatatgaatactgttgctgttcaaagcaaccttgcaaatttagagcatgctttttacgtagcagaaaaaattggtgttataagacttctggaccctgaagatgtcgatgtctcctcacctgatgaaaaatcagtaataacttacgtgtcatctctctatgatgcatttcctaaagtccctgaaggtggggaaggcattggtgcaaatgatgttgaagtcaaatggattgaataccagaatatggtgaactacctcatccaatggattagacaccatgtgaccacaatgtctgagagaacatttcctaataatcctgtagaactgaaggcactttataatcagtatttacagtttaaagaaacagaaattccaccaaaggagacagaaaaatcaaaaattaaacgtctatataaattattagagatttggatagaatttggacgcatcaagctccttcaaggttatcatccaaatgacatagaaaaagagtgggggaaactcattattgccatgctagagagagagaaggcccttcgtccagaagtagaaaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagaagtcactggaagaagaaaagaaagaacatgttgaaaaagccaaagaattgcaaaaatgggtatcaaatatcagcaagacattgaaagatgcagagaaggctggaaaacctcccttctctaagcaaaagatttccagtgaggaaatatcaaccaagaaggaacaattatcggaagcacttcaaactatacagctttttttggcaaaacatggagacaaaatgacagatgaagaaagaaatgaattggaaaaacaagtgaaaactcttcaggaaagttataatttattattcagtgaatctctgaaacagctacaagaatcacaaacctcaggagatgtaaaggtagaggagaagctggataaagtgattgcaggcaccattgatcagacaactggagaagtcctttcagtctttcaagcagttttaagaggcctcattgactatgacacaggaattaggttgcttgagacacagctaatgatttctggtctaatttcaccagaattaagaaagtgctttgaccttaaagatgccaaaagtcatggccttattgatgaacaaattctgtgccaactcaaagaactaagtaaagctaaggagattatttctgctgcgtcacctaccacaattccagtactggatgctctagctcaaagcatgataacagaatccatggccatcaaagttcttgagatactgctttctacaggctctctggttattccagccacaggagaacagttgaccctacagaaggctttccaacagaacttggtttcctcagcattattttctaaagttctggaaaggcaaaatatgtgcaaagatcttattgacccctgcacctctgagaaggtttctttaatagatatggtacaaagaagtactttacaggaaaacacagggatgtggcttctacctgtgagaccacaagaaggaggtagaataacattaaaatgtggaagaaacataagcattttaagagcagctcatgaaggtctcatagaccgtgaaaccatgtttaggttgttaagtgcacagcttctttctggaggtctgatcaattccaactctggccaaagaatgactgttgaagaagctgtcagagaaggggtgattgacagggacactgctagcagtatcctcacatatcaggttcaaactggtggaatcatccagtcaaaccctgccaagcgtttaactgtagacgaagcagtacagtgtgatttaataacttccagcagtgctcttctggtcctggaagctcagcgaggctatgttggactcatttggccccattctggtgaaatatttcccacatcatcttccttgcagcaagaattgattacaaatgaattggcctacaaaatcctgaatggcagacaaaaaatagctgctctttatattccagaaagttctcaagtcattggtttggatgctgctaaacagctaggaattatagacaacaacacagcatcaattttaaaaaatataacactgcctgataaaatgccagatttaggagatttagaagcttgtaaaaatgccagaagatggctctctttttgtaaatttcaaccctccacagttcatgattacagacaagaagaggatgtttttgatggagaagaacctgtcactactcagacctcagaagaaactaaaaaattatttctatcttatttaatgataaatagctatatggatgcaaacacagggcaaaggcttttgctgtacgatggagacttggatgaggctgttggcatgctactggaaggctgtcatgcagaatttgatggaaacacagccataaaagaatgtctcgatgtcttaagctcatctggtgtatttcttaataatgcttcaggtagagaaaaggatgaatgtacagctacaccaagtagtttcaataaatgtcactgtggagaacctgaacatgaagagactcctgaaaatagaaagtgtgctatagatgaagaatttaatgaaatgagaaatactgttatcaatagtgaattttctcagtcaggaaaactggcaagtacaatatcaattgatcctaaagttaacagttcacccagtgtgtgtgttcccagtctcatatcatatttaacacagactgaacttgcagacattagcatgcttagaagtgactctgaaaacatacttacaaactatgaaaatcaaagccgagtggaaacaaatgaacgtgcaaatgaatgtagtcattctaaaaacattcaaaactttccaagtgatttaatagaaaatcctattatgaaatcaaaaatgagtaaattctgtggtgtgaatgaaacagagaatgaagataatacaaacagggattcacctatctttgactattcccccaggctaagtgccttgttaagtcatgataaattgatgcacagtcagggaagttttaatgatacacacaccccagagagcaatggaaataagtgtgaagccccagccttatcattcagtgacaaaaccatgttgtcaggtcaaagaataggagaaaaatttcaagaccagtttctgggaattgcagctattaacatcagtttaccaggagagcagtatggacagaaatctttaaatatgatttctagtaatcctcaagtacaatatcacaatgataaatacatttcaaatacttctggtgaggatgaaaaaacacatccaggttttcagcagatgcctgaagacaaggaagatgagtctgaaatagaagagtattcctgtgctgtgactccagggggtgatactgataatgccattgtgtctcttacttgtgctacaccattgcttgatgaaaccatcagtgctagtgactatgaaacgtcactgctgaatgatcagcagaataacacaggaacagacactgatagtgatgatgatttttatgatactcccttgtttgaagatgatgaccatgattctttgcttcttgatggtgatgatcgtgattgcctgcaccctgaggactacgacacactgcaagaggaaaatgatgagacggcttctcctgctgatgttttttatgatgtctcaaaagagaatgaaaattccatggttccccagggggcaccagttggtagcttaagtgtgaagaacaaagcacattgtcttcaggatttccttatggatgttgagaaagatgaattagattctggtgaaaaaatacatttaaatcctgttggctcagataaggtgaatggacagtcactggaaactggatcagaaagggaatgcacaaatatccttgaaggtgatgaatctgactcattgactgattatgatattgtaggaggaaaagagagcttcactgcatcattaaaatttgatgacagtggcagttggagaggaagaaaggaagagtatgtaactggacaggaatttcactccgatactgatcatttagattctatgcaaagtgaagaaagttatggggattatatatatgacagtaatgatcaggatgacgatgatgatgatggcattgatgaagaaggaggaggtataagagatgagaatggaaagcccaggtgccaaaatgtggctgaagatatggatatccagttgtgtgcctctattttaaatgaaaacagtgatgaaaatgaaaatattaatacaatgattcttctggataaaatgcacagttgtagctctttagaaaaacagcaaagggtaaatgttgtacagctagcatcacctagtgaaaataacttagttactgaaaaaagcaaccttccagaatatacaactgagattgctggaaaaagcaaagaaaatctgttgaaccatgagatggtacttaaggatgtattgccgcctatcattaaagacactgaatctgaaaaaacttttggccctgcaagtatttcacatgataataataatatcagttcaacttctgaattaggtactgatctagcaaacacaaaggttaagttgattcaagggtcagaattgccagaattgactgattctgtgaaaggtaaagatgaatattttaagaatatgacaccaaaagttgactcatctcttgatcacatcatttgtactgagcctgatttaataggaaaacctgctgaggaaagccatttgtcattgatagcctctgtaactgacaaagatcctcaaggaaatggaagcgatctcattaaagggagagatggcaaaagtgatattctaatagaagatgaaacatcaattcagaaaatgtacttgggtgaaggagaagtgcttgtagaaggtctagtagaagaagaaaataggcatctcaaacttttgcctggtaaaaatacaagggatagtttcaagttaattaatagtcagtttccatttccacaaatcacaaacaatgaagaacttaatcagaaaggaagccttaaaaaagcaactgtaactcttaaagatgaaccaaataatctacaaataatagttagtaaaagtcctgttcagtttgagaatcttgaagaaatttttgacacatcagtttccaaagagattagtgatgacattacttcagacattacatcgtgggaagggaatacacattttgaggagtcattcactgatggacctgagaaagagcttgatctgtttacttacttaaaacattgtgctaaaaatataaaagcaaaagatgtagccaaaccaaatgaagatgtcccaagccatgttttaataactgcccctcccatgaaagaacatttacaattaggagttaataatacaaaagagaagtccactagtacccaaaaagactcacctcttaatgacatgatccaaagcaatgatctttgtagtaaagaaagcatctcaggaggaggaacagaaatttctcagttcacaccagaaagtattgaagccacactttcaatattatctcgtaaacatgtagaagatgttgggaaaaatgattttctgcagtcggagcggtgtgcaaatggattaggaaatgataactccagtaacactttaaatactgactattcattcttagaaattaataataagaaagaaagaattgagcaacagctaccaaaagaacaagccttgtctccaagatcccaagaaaaggaggttcagattcctgaattgtctcaggtatttgtggaggatgtaaaggatatcttaaaaagcaggttgaaagaaggtcatatgaaccctcaagaggttgaagaaccttcagcctgtgcagacactaaaattttaattcaaaatttaattaaaaggattaccacatcacagttggtaaatgaggcatctactgtgcccagcgactctcaaatgagtgactcttctggagtttcccccatgactaactcatcagaactaaagccagaaagtagagatgatcctttctgtattggaaatcttaagtctgagcttctccttaatatattgaagcaagatcaacatagccaaaaaattacaggagtatttgaattgatgagagaattaactcatatggagtatgacctagagaaaagaggcattacgtctaaagtacttccactgcagcttgaaaatattttctacaaactgcttgctgatggatattcagagaaaatagaacatgttggagactttaatcaaaaagcatgttctacatctgagatgatggaagaaaagccacatattcttggtgatattaaaagcaaagaaggaaactactattctcctaatttagaaactgtaaaagaaattggactagaaagctctactgtgtgggcatcaacattgccaagagatgagaagctcaaggatctgtgtaatgatttcccaagccatttggaatgtacttcagggtctaaagagatggcttctggagatagctcaaccgaacaattttccagtgaattacagcagtgtttacagcacactgaaaaaatgcatgagtatttgacattgcttcaagatatgaaaccccccttagacaaccaggaatctctggataacaacttggaagctttgaagaatcaacttagacagttggagacatttgaattgggattagctccaattgctgttattttaagaaaagatatgaagttggcagaagagtttttaaagtctcttcccagtgactttcccagaggccatgttgaagaattgagtattagccaccagagtttgaagaccgccttctcttccctcagcaacgtgtcttcagaaagaacgaaacagatcatgcttgcgatcgactctgaaatgtctaaactagcagtttcccatgaagaatttctgcataaacttaagtcattctcagattgggtatcagagaagagcaaatctgtgaaggatattgagattgtgaatgttcaagattctgagtatgtaaagaaacgtttggagtttctcaagaatgtattaaaagaccttggacataccaaaatgcagctggagactactgcctttgatgtgcagttcttcatttctgaatatgcacaggatctgtctcccaaccaaagcaaacaactgctgaggctcttaaatacaactcagaagtgttttcttgatgtacaggagtcagtaactacccaggtggaacgtttagagactcagttacatctagaacaagatcttgatgatcagaagattgtagcagagcgtcagcaggagtataaagagaaactccaagggatatgtgatcttcttacccaaactgaaaaccgcctaattggtcaccaagaagccttcatgattggagatggcacagttgagttaaagaaatatcagtccaagcaagaggaattacagaaagatatgcaaggaagtgcacaggcattggctgaagtagtgaaaaacacagagaacttcttaaaagagaatggtgaaaagctgtcacaggaagataaggctttgattgaacagaaacttaatgaagctaagataaagtgtgaacagcttaatttaaaagcagaacagtctaaaaaggagctggataaagttgtgacaacagcaatcaaggaagaaactgaaaaggtagcagcagtgaagcagctggaagagagcaaaaccaaaatagaaaaccttttggactggttgtcaaatgttgacaaagactcagaaagggcagggacaaaacacaaacaggtaatcgaacagaacgggacccattttcaagaaggtgatggcaagtcagcaattggagaagaggatgaagttaatggtaacctgttggagactgatgttgatgggcaagttggaaccactcaggagaatctgaatcagcaatatcagaaagttaaggcccaacacgagaagatcatctctcagcaccaagcagtgatcatagccactcagtctgcacaagtgttgcttgagaaacagggtcagtatctctctcctgaagaaaaagagaaactgcaaaagaacatgaaggaactgaaagtgcattatgaaactgcactggctgagtcagagaagaaaatgaagttaactcactctctgcaggaagaattagaaaagtttgatgctgactataccgagtttgagcactggctacagcagtcagaacaagaacttgaaaacctggaggcaggtgcagatgacatcaatggtttaatgaccaaattgaagaggcagaagagtttctcagaagacgttatttctcacaaaggtgacttgagatacatcacaatttctggaaacagagtgttggaagctgccaaatcttgcagcaagagagacggtggcaaggttgatacttctgcaacccacagagaagtgcagcgcaagttggatcatgctactgatcggttcaggtctctctactctaagtgcaatgttcttggaaataatcttaaagatctggtggataaatatcaacactatgaagatgcttcatgtggacttcttgctggactccaggcctgtgaggccacagcgagcaaacacttatctgaacctattgcggtggaccccaaaaatcttcaaaggcaattagaagagaccaaggctttgcaaggacagatatcaagtcagcaggttgctgtagagaaactgaagaaaacggctgaagtgcttttagatgccaggggatctttacttccagccaagaatgatatccagaaaacacttgatgacattgttgggagatatgaggatctgtccaagtctgttaatgaacgaaatgaaaaactccagataaccttgacccgttcactgagtgtgcaggatggcttggatgaaatgctggactggatgggaaatgtggaaagttctctgaaagaacaagatgttggaacaggatattgcaggtcgtcagagcagtataaatgccatgaatgaaaaagtgaagaaatttatggaaacaacagatccatccactgcatcctcactgcaagccaaaatgaaagacttgtctgctcggttttcagaagcaagtcataaacacaaagaaactcttgccaaaatggaggagctaaaaaccaaagtagaactgtttgagaacctctcagaaaagctccagacatttttagaaacaaaaactcaggctcttactgaagtagatgtgccaggaaaagatgttactgaattgtctcagtatatgcaggaatcaacttctgaatttttagaacacaagaaacatcttgaagttttgcatagtctcttgaaggagatatccagccatggcttaccaagtgataaggctttggtccttgaaaaaacaaataatttgtcaaagaaattcaaggaaatggaggataccatcaaagaaaaaaaagaagctgtaacttcttgtcaagaacagttggatgctttccaagttcttgttaaatcattgaagtcatggataaaagaaacaacaaaaaaagttcccattgtacagccttcttttggtgcagaggatttaggaaaatctttggaagacactaagaaattacaagaaaagtggagtttaaaaacaccagagattcagaaagtaaacaacagtgggatctcactatgtaacttaataagtgctgtgaccacccctgcaaaggcaatagcagcagttaaatcaggtggagcagtattaaatggtgaaggaacagccacaaatactgaggaattttgggcaaataaaggtttaacatccattaaaaaggacatgactgacataagtcatggttatgaagatcttggcctcttactcaaggacaaaatagcggaactgaacactaaactctccaaattgcaaaaggctcaggaagaatcaagtgcaatgatgcagtggttacagaaaatgaacaaaactgcaacaaaatggcagcagacacctgcacctacagatactgaagctgtgaagactcaagttgagcagaataagtcgtttgaggcagaactgaagcagaatgtaaacaaagtacaggagttgaaagacaaattgacagagctgttggaggagaacccagatactcctgaggcccccagatggaaacagatgttgacagaaatagattctaagtggcaagaactcaatcaattaacaattgatagacaacaaaaactggaagaatcctccaataatctaacccagttccagactgtagaggcccaattgaaacagtggcttgtggaaaaagaacttatggtcagtgttcttgggcccttgtcaattgacccaaatatgctaaacacacaaaggcagcaggtgcagattttgctgcaagaattcgccactcggaaacctcaatatgaacagctgacagcagctggtcagggcattctgagcaggcctggagaagacccttctttacgtgggattgtgaaagagcaactggcagctgtgacccaaaaatgggatagcctaacagggcaattgagtgacagatgtgactggattgaccaagccattgttaaaagcacacagtatcaaagcctgctgagaagcctttctgataaactgagtgacttggataataaactcagcagcagtctggctgtgagcacgcaccctgatgctatgaaccaacagttggaaacagcccaaaaaatgaagcaggagatacagcaggaaaagaagcagataaaagtggcccaggcactctgtgaggatttgtcagcactggttaaagaagagtacttgaaagcagaacttagtaggcaactagaaggcatcttaaaatcatttaaggatgttgaacagaaagcagagaatcatgtccagcaccttcagtcggcctgtgcaagctctcatcaatttcagcaaatgtctagagattttcaggcttggctggatacaaagaaagaagagcaaaacaaatctcatccaatatctgccaaactcgatgtcttggagtcattaattaaagatcataaagactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagcaggtgaaagaaagagaaaacaagttaaaagagtcattggaaaaagcccttaagtataaagagcaagtagagactctctggccatggatagacaaatgccaaaacaacctggaggaaataaaattttgcttggatcctgctgaaggagagaattctattgccaagttaaagtctctgcagaaggaaatggaccaacactttggtatggtagaattactgaacaacacagccaatagcttgctcagtgtctgtgagatagataaagaagttgttacagatgagaataagtcactgatccagaaggtggacatggtcactgaacaacttcacagtaagaaattctgtctggagaacatgactcagaagtttaaagaatttcaagaagtttccaaagaatctaaaaggcagcttcagtgtgcaaaggagcagctagatatccatgattcgctgggatcccaggcttacagtaacaaatacctgaccatgttgcaaactcagcagaaatcacttcaggccttgaagcatcaggtagatttggctaaaagacttgcacaggaccttgtggtagaggcctcagactcaaagggaacctctgatgttttattacaagtggaaaccatagctcaagagcatagtacactaagtcagcaggttgatgaaaagtgttctttcttagaaaccaagcttcagggcattgggcatttccagaataccattcgagaaatgttttctcagttcgcagagtttgatgatgaactggatagcatggctccagtggggagagatgcagaaacattgcaaaagcaaaaggaaactataaaagcctttctaaagaaactagaagccctcatggcaagcaatgacaatgccaataaaacctgcaagatgatgttagccacagaagaaacctctcctgaccttgttggaatcaaaagggacttggaggccttaagcaaacaatgcaacaagttactggaccgagcccaagccagagaagagcaggttgaagggacaattaagcgccttgaagaattttacagcaaattgaaagaattttctattctgctccagaaagccgaagaacatgaagagtcacaaggtcctgttggtatggaaacggagacaattaatcagcagcttaacatgttcaaggtattccagaaagaagagattgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagccttagaagatgacatcatcaatcacaataaacatttacaccaggctgttagcattggccagtccttaaaggttttgagctccagggaggataaagatatggtgcagagtaaattagacttctctcaagtatggtacattgagattcaagagaaaagtcacagcaggtctgagctcctccagcaggccttatgtaatgctaagatttttggggaagatgaagttgaactgatgaactggctgaatgaagtgcatgacaaactgagcaagctctcagtccaggattacagcactgaggggctatggaagcagcagtctgaacttcgggttctgcaagaggacatcttactcaggaaacaaaatgtagatcaggctttactaaatggtttagaactacttaaacaaaccacaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcagtttgaccaagcagctgatgctgagttatcctggattactgaaacagaaaaaaaattgatgtctctgggtgacatcaggcttgagcaagaccagacttctgctcagcttcaagttcaaaagacattcaccatggagattttgagacacaaggatattattgatgaccttgttaaatctgggcataaaatcatgaccgcatgcagtgaagaggaaaagcaatcaatgaagaaaaaactggacaaggtactgaagaactatgataccatctgccagattaattcagaaaggtatctgcagctggaacgggcacagtccctggttaaccaattctgggaaacatatgaagaactttggccatggctgacagaaacacaatcaatcatctctcagcttcccgccccagcccttgaatatgaaactctaaggcagcagcaggaagaacatcggcaactgcgtgagttgatagctgaacacaagcctcatatagataagatgaacaaaactgggccacagttactggaattgagccctggggaaggcttttctatccaagagaagtatgtggcagccgacaccctttacagtcaaattaaagaagatgtcaaaaagcgtgctgtggcactggatgaagccatttctcaatcaactcagttccatgacaagatagatcagatccttgagagcctggaacgcatcgtggaacgtctgaggcagccaccctctatctctgcagaggttgagaagatcaaggaacagatcagtgaaaataagaatgtgtcagtagacatggaaaagctacagccgttgtatgaaactcttaaacagaggggagaggaaatgattgctagatctggggggactgataaagacatatctgccaaagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagagaccataagggaagaaatagatggactacaggaggagctggatatagttattaacctaggttctgaactcattgcggcatgtggggagcctgataaacccattgtcaagaagagtatagatgagttaaattcagcatgggattctctaaataaagcttggaaagaccggattgacaaacttgaggaggcaatgcaggctgccgttcagtaccaggatggactgcaggcggtatttgactgggtagatattgcaggtggtaaattagcttcaatgtctccaattggaacagatctcgaaactgtcaagcagcagattgaagagctaaagcaatttaagtctgaggcctatcaacagcagatagaaatggaaagactgaatcatcaagcagagcttttgctaaagaaagtaacagaagagagtgacaaacacactgttcaagacccattaatggaactgaaattgatatgggatagcctggaggagagaatcatcaacagacagcataaactggagggtgctctattagccttgggtcagttccaacatgccctggatgagctcctggcatggctgacacacaccgagggcttgctaagtgagcagaaacctgttggaggagaccctaaagccattgaaattgaacttgccaagcatcatgtgctccaaaatgatgtattagcccatcagtccacagtggaagccgttaataaagcaggaaatgatctaattgaatcaagtgcaggagaagaagcaagcaaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagattctccatcctttaacacgcaattatggtaaaccatggttgacaaacagcaaaatgtcaactccttgtaaagcagcagagtgctcagactttcccgtgccatctgcagagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatgg

SEQ ID NO: 9067 - DNA, 22431 bp, Homo sapiens
acttcggcatggcgggttacctctcccctgctgcttacctgtacgtggaggagcaggagtatctccaggcctacgaggatgtcctggagaggtacaaagatgaacgggacaaagttcagaagaaaacatttacaaaatggataaatcagcatctcatgaaggttcgaaaacatgtgaatgatctctatgaagacttaagggatggacacaatttgatttctcttttagaggttctttcaggagataccttgcccagagaaaaaggtcggatgcgttttcacagactacagaatgtacaaattgcacttgactatttgaaaagacgccaggtgaaattagtgaatattagaaatgatgacataacagatggaaatcccaaattgactttgggattaatctggacaataattttgcactttcagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggccggacctgatagatatgaatactgttgctgttcaaagcaaccttgcaaatttagagcatgctttttacgtagcagaaaaaattggtgttataagacttctggaccctgaagatgtcgatgtctcctcacctgatgaaaaatcagtaataacttacgtgtcatctctctatgatgcatttcctaaagtccctgaaggtggggaaggcattggtgcaaatgatgttgaagtcaaatggattgaataccagaatatggtgaactacctcatccaatggattagacaccatgtgaccacaatgtctgagagaacatttcctaataatcctgtagaactgaaggcactttataatcagtatttacagtttaaagaaacagaaattccaccaaaggagacagaaaaatcaaaaattaaacgtctatataaattattagagatttggatagaatttggacgcatcaagctccttcaaggttatcatccaaatgacatagaaaaagagtgggggaaactcattattgccatgctagagagagagaaggcccttcgtccagaagtagaaaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagaagtcactggaagaagaaaagaaagaacatgttgaaaaagccaaagaattgcaaaaatgggtatcaaatatcagcaagacattgaaagatgcagagaaggctggaaaacctcccttctctaagcaaaagatttccagtgaggaaatatcaaccaagaaggaacaattatcggaagcacttcaaactatacagctttttttggcaaaacatggagacaaaatgacagatgaagaaagaaatgaattggaaaaacaagtgaaaactcttcaggaaagttataatttattattcagtgaatctctgaaacagctacaagaatcacaaacctcaggagatgtaaaggtagaggagaagctggataaagtgattgcaggcaccattgatcagacaactggagaagtcctttcagtctttcaagcagttttaagaggcctcattgactatgacacaggaattaggttgcttgagacacagctaatgatttctggtctaatttcaccagaattaagaaagtgctttgaccttaaagatgccaaaagtcatggccttattgatgaacaaattctgtgccaactcaaagaactaagtaaagctaaggagattatttctgctgcgtcacctaccacaattccagtactggatgctctagctcaaagcatgataacagaatccatggccatcaaagttcttgagatactgctttctacaggctctctggttattccagccacaggagaacagttgaccctacagaaggctttccaacagaacttggtttcctcagcattattttctaaagttctggaaaggcaaaatatgtgcaaagatcttattgacccctgcacctctgagaaggtttctttaatagatatggtacaaagaagtactttacaggaaaacacagggatgtggcttctacctgtgagaccacaagaaggaggtagaataacattaaaatgtggaagaaacataagcattttaagagcagctcatgaaggtctcatagaccgtgaaaccatgtttaggttgttaagtgcacagcttctttctggaggtctgatcaattccaactctggccaaagaatgactgttgaagaagctgtcagagaaggggtgattgacagggacactgctagcagtatcctcacatatcaggttcaaactggtggaatcatccagtcaaaccctgccaagcgtttaactgtagacgaagcagtacagtgtgatttaataacttccagcagtgctcttctggtcctggaagctcagcgaggctatgttggactcatttggccccattctggtgaaatatttcccacatcatcttccttgcagcaagaattgattacaaatgaattggcctacaaaatcctgaatggcagacaaaaaatagctgctctttatattccagaaagttctcaagtcattggtttggatgctgctaaacagctaggaattatagacaacaacacagcatcaattttaaaaaatataacactgcctgataaaatgccagatttaggagatttagaagcttgtaaaaatgccagaagatggctctctttttgtaaatttcaaccctccacagttcatgattacagacaagaagaggatgtttttgatggagaagaacctgtcactactcagacctcagaagaaactaaaaaattatttctatcttatttaatgataaatagctatatggatgcaaacacagggcaaaggcttttgctgtacgatggagacttggatgaggctgttggcatgctactggaaggctgtcatgcagaatttgatggaaacacagccataaaagaatgtctcgatgtcttaagctcatctggtgtatttcttaataatgcttcaggtagagaaaaggatgaatgtacagctacaccaagtagtttcaataaatgtcactgtggagaacctgaacatgaagagactcctgaaaatagaaagtgtgctatagatgaagaatttaatgaaatgagaaatactgttatcaatagtgaattttctcagtcaggaaaactggcaagtacaatatcaattgatcctaaagttaacagttcacccagtgtgtgtgttcccagtctcatatcatatttaacacagactgaacttgcagacattagcatgcttagaagtgactctgaaaacatacttacaaactatgaaaatcaaagccgagtggaaacaaatgaacgtgcaaatgaatgtagtcattctaaaaacattcaaaactttccaagtgatttaatagaaaatcctattatgaaatcaaaaatgagtaaattctgtggtgtgaatgaaacagagaatgaagataatacaaacagggattcacctatctttgactattcccccaggctaagtgccttgttaagtcatgataaattgatgcacagtcagggaagttttaatgatacacacaccccagagagcaatggaaataagtgtgaagccccagccttatcattcagtgacaaaaccatgttgtcaggtcaaagaataggagaaaaatttcaagaccagtttctgggaattgcagctattaacatcagtttaccaggagagcagtatggacagaaatctttaaatatgatttctagtaatcctcaagtacaatatcacaatgataaatacatttcaaatacttctggtgaggatgaaaaaacacatccaggttttcagcagatgcctgaagacaaggaagatgagtctgaaatagaagagtattcctgtgctgtgactccagggggtgatactgataatgccattgtgtctcttacttgtgctacaccattgcttgatgaaaccatcagtgctagtgactatgaaacgtcactgctgaatgatcagcagaataacacaggaacagacactgatagtgatgatgatttttatgatactcccttgtttgaagatgatgaccatgattctttgcttcttgatggtgatgatcgtgattgcctgcaccctgaggactacgacacactgcaagaggaaaatgatgagacggcttctcctgctgatgttttttatgatgtctcaaaagagaatgaaaattccatggttccccagggggcaccagttggtagcttaagtgtgaagaacaaagcacattgtcttcaggatttccttatggatgttgagaaagatgaattagattctggtgaaaaaatacatttaaatcctgttggctcagataaggtgaatggacagtcactggaaactggatcagaaagggaatgcacaaatatccttgaaggtgatgaatctgactcattgactgattatgatattgtaggaggaaaagagagcttcactgcatcattaaaatttgatgacagtggcagttggagaggaagaaaggaagagtatgtaactggacaggaatttcactccgatactgatcatttagattctatgcaaagtgaagaaagttatggggattatatatatgacagtaatgatcaggatgacgatgatgatgatggcattgatgaagaaggaggaggtataagagatgagaatggaaagcccaggtgccaaaatgtggctgaagatatggatatccagttgtgtgcctctattttaaatgaaaacagtgatgaaaatgaaaatattaatacaatgattcttctggataaaatgcacagttgtagctctttagaaaaacagcaaagggtaaatgttgtacagctagcatcacctagtgaaaataacttagttactgaaaaaagcaaccttccagaatatacaactgagattgctggaaaaagcaaagaaaatctgttgaaccatgagatggtacttaaggatgtattgccgcctatcattaaagacactgaatctgaaaaaacttttggccctgcaagtatttcacatgataataataatatcagttcaacttctgaattaggtactgatctagcaaacacaaaggttaagttgattcaagggtcagaattgccagaattgactgattctgtgaaaggtaaagatgaatattttaagaatatgacaccaaaagttgactcatctcttgatcacatcatttgtactgagcctgatttaataggaaaacctgctgaggaaagccatttgtcattgatagcctctgtaactgacaaagatcctcaaggaaatggaagcgatctcattaaagggagagatggcaaaagtgatattctaatagaagatgaaacatcaattcagaaaatgtacttgggtgaaggagaagtgcttgtagaaggtctagtagaagaagaaaataggcatctcaaacttttgcctggtaaaaatacaagggatagtttcaagttaattaatagtcagtttccatttccacaaatcacaaacaatgaagaacttaatcagaaaggaagccttaaaaaagcaactgtaactcttaaagatgaaccaaataatctacaaataatagttagtaaaagtcctgttcagtttgagaatcttgaagaaatttttgacacatcagtttccaaagagattagtgatgacattacttcagacattacatcgtgggaagggaatacacattttgaggagtcattcactgatggacctgagaaagagcttgatctgtttacttacttaaaacattgtgctaaaaatataaaagcaaaagatgtagccaaaccaaatgaagatgtcccaagccatgttttaataactgcccctcccatgaaagaacatttacaattaggagttaataatacaaaagagaagtccactagtacccaaaaagactcacctcttaatgacatgatccaaagcaatgatctttgtagtaaagaaagcatctcaggaggaggaacagaaatttctcagttcacaccagaaagtattgaagccacactttcaatattatctcgtaaacatgtagaagatgttgggaaaaatgattttctgcagtcggagcggtgtgcaaatggattaggaaatgataactccagtaacactttaaatactgactattcattcttagaaattaataataagaaagaaagaattgagcaacagctaccaaaagaacaagccttgtctccaagatcccaagaaaaggaggttcagattcctgaattgtctcaggtatttgtggaggatgtaaaggatatcttaaaaagcaggttgaaagaaggtcatatgaaccctcaagaggttgaagaaccttcagcctgtgcagacactaaaattttaattcaaaatttaattaaaaggattaccacatcacagttggtaaatgaggcatctactgtgcccagcgactctcaaatgagtgactcttctggagtttcccccatgactaactcatcagaactaaagccagaaagtagagatgatcctttctgtattggaaatcttaagtctgagcttctccttaatatattgaagcaagatcaacatagccaaaaaattacaggagtatttgaattgatgagagaattaactcatatggagtatgacctagagaaaagaggcattacgtctaaagtacttccactgcagcttgaaaatattttctacaaactgcttgctgatggatattcagagaaaatagaacatgttggagactttaatcaaaaagcatgttctacatctgagatgatggaagaaaagccacatattcttggtgatattaaaagcaaagaaggaaactactattctcctaatttagaaactgtaaaagaaattggactagaaagctctactgtgtgggcatcaacattgccaagagatgagaagctcaaggatctgtgtaatgatttcccaagccatttggaatgtacttcagggtctaaagagatggcttctggagatagctcaaccgaacaattttccagtgaattacagcagtgtttacagcacactgaaaaaatgcatgagtatttgacattgcttcaagatatgaaaccccccttagacaaccaggaatctctggataacaacttggaagctttgaagaatcaacttagacagttggagacatttgaattgggattagctccaattgctgttattttaagaaaagatatgaagttggcagaagagtttttaaagtctcttcccagtgactttcccagaggccatgttgaagaattgagtattagccaccagagtttgaagaccgccttctcttccctcagcaacgtgtcttcagaaagaacgaaacagatcatgcttgcgatcgactctgaaatgtctaaactagcagtttcccatgaagaatttctgcataaacttaagtcattctcagattgggtatcagagaagagcaaatctgtgaaggatattgagattgtgaatgttcaagattctgagtatgtaaagaaacgtttggagtttctcaagaatgtattaaaagaccttggacataccaaaatgcagctggagactactgcctttgatgtgcagttcttcatttctgaatatgcacaggatctgtctcccaaccaaagcaaacaactgctgaggctcttaaatacaactcagaagtgttttcttgatgtacaggagtcagtaactacccaggtggaacgtttagagactcagttacatctagaacaagatcttgatgatcagaagattgtagcagagcgtcagcaggagtataaagagaaactccaagggatatgtgatcttcttacccaaactgaaaaccgcctaattggtcaccaagaagccttcatgattggagatggcacagttgagttaaagaaatatcagtccaagcaagaggaattacagaaagatatgcaaggaagtgcacaggcattggctgaagtagtgaaaaacacagagaacttcttaaaagagaatggtgaaaagctgtcacaggaagataaggctttgattgaacagaaacttaatgaagctaagataaagtgtgaacagcttaatttaaaagcagaacagtctaaaaaggagctggataaagttgtgacaacagcaatcaaggaagaaactgaaaaggtagcagcagtgaagcagctggaagagagcaaaaccaaaatagaaaaccttttggactggttgtcaaatgttgacaaagactcagaaagggcagggacaaaacacaaacaggtaatcgaacagaacgggacccattttcaagaaggtgatggcaagtcagcaattggagaagaggatgaagttaatggtaacctgttggagactgatgttgatgggcaagttggaaccactcaggagaatctgaatcagcaatatcagaaagttaaggcccaacacgagaagatcatctctcagcaccaagcagtgatcatagccactcagtctgcacaagtgttgcttgagaaacagggtcagtatctctctcctgaagaaaaagagaaactgcaaaagaacatgaaggaactgaaagtgcattatgaaactgcactggctgagtcagagaagaaaatgaagttaactcactctctgcaggaagaattagaaaagtttgatgctgactataccgagtttgagcactggctacagcagtcagaacaagaacttgaaaacctggaggcaggtgcagatgacatcaatggtttaatgaccaaattgaagaggcagaagagtttctcagaagacgttatttctcacaaaggtgacttgagatacatcacaatttctggaaacagagtgttggaagctgccaaatcttgcagcaagagagacggtggcaaggttgatacttctgcaacccacagagaagtgcagcgcaagttggatcatgctactgatcggttcaggtctctctactctaagtgcaatgttcttggaaataatcttaaagatctggtggataaatatcaacactatgaagatgcttcatgtggacttcttgctggactccaggcctgtgaggccacagcgagcaaacacttatctgaacctattgcggtggaccccaaaaatcttcaaaggcaattagaagagaccaaggctttgcaaggacagatatcaagtcagcaggttgctgtagagaaactgaagaaaacggctgaagtgcttttagatgccaggggatctttacttccagccaagaatgatatccagaaaacacttgatgacattgttgggagatatgaggatctgtccaagtctgttaatgaacgaaatgaaaaactccagataaccttgacccgttcactgagtgtgcaggatggcttggatgaaatgctggactggatgggaaatgtggaaagttctctgaaagaacaaggtcaagtgcctttaaactctactgctcttcaggatattatcagtaaaaacattatgttggaacaggatattgcaggtcgtcagagcagtataaatgccatgaatgaaaaagtgaagaaatttatggaaacaacagatccatccactgcatcctcactgcaagccaaaatgaaagacttgtctgctcggttttcagaagcaagtcataaacacaaagaaactcttgccaaaatggaggagctaaaaaccaaagtagaactgtttgagaacctctcagaaaagctccagacatttttagaaacaaaaactcaggctcttactgaagtagatgtgccaggaaaagatgttactgaattgtctcagtatatgcaggaatcaacttctgaatttttagaacacaagaaacatcttgaagttttgcatagtctcttgaaggagatatccagccatggcttaccaagtgataaggctttggtccttgaaaaaacaaataatttgtcaaagaaattcaaggaaatggaggataccatcaaagaaaaaaaagaagctgtaacttcttgtcaagaacagttggatgctttccaagttcttgttaaatcattgaagtcatggataaaagaaacaacaaaaaaagttcccattgtacagccttcttttggtgcagaggatttaggaaaatctttggaagacactaagaaattacaagaaaagtggagtttaaaaacaccagagattcagaaagtaaacaacagtgggatctcactatgtaacttaataagtgctgtgaccacccctgcaaaggcaatagcagcagttaaatcaggtggagcagtattaaatggtgaaggaacagccacaaatactgaggaattttgggcaaataaaggtttaacatccattaaaaaggacatgactgacataagtcatggttatgaagatcttggcctcttactcaaggacaaaatagcggaactgaacactaaactctccaaattgcaaaaggctcaggaagaatcaagtgcaatgatgcagtggttacagaaaatgaacaaaactgcaacaaaatggcagcagacacctgcacctacagatactgaagctgtgaagactcaagttgagcagaataagtcgtttgaggcagaactgaagcagaatgtaaacaaagtacaggagttgaaagacaaattgacagagctgttggaggagaacccagatactcctgaggcccccagatggaaacagatgttgacagaaatagattctaagtggcaagaactcaatcaattaacaattgatagacaacaaaaactggaagaatcctccaataatctaacccagttccagactgtagaggcccaattgaaacagtggcttgtggaaaaagaacttatggtcagtgttcttgggcccttgtcaattgacccaaatatgctaaacacacaaaggcagcaggtgcagattttgctgcaagaattcgccactcggaaacctcaatatgaacagctgacagcagctggtcagggcattctgagcaggcctggagaagacccttctttacgtgggattgtgaaagagcaactggcagctgtgacccaaaaatgggatagcctaacagggcaattgagtgacagatgtgactggattgaccaagccattgttaaaagcacacagtatcaaagcctgctgagaagcctttctgataaactgagtgacttggataataaactcagcagcagtctggctgtgagcacgcaccctgatgctatgaaccaacagttggaaacagcccaaaaaatgaagcaggagatacagcaggaaaagaagcagataaaagtggcccaggcactctgtgaggatttgtcagcactggttaaagaagagtacttgaaagcagaacttagtaggcaactagaaggcatcttaaaatcatttaaggatgttgaacagaaagcagagaatcatgtccagcaccttcagtcggcctgtgcaagctctcatcaatttcagcaaatgtctagagattttcaggcttggctggatacaaagaaagaagagcaaaacaaatctcatccaatatctgccaaactcgatgtcttggagtcattaattaaagatcataaagactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagcaggtgaaagaaagagaaaacaagttaaaagagtcattggaaaaagcccttaagtataaagagcaagtagagactctctggccatggatagacaaatgccaaaacaacctggaggaaataaaattttgcttggatcctgctgaaggagagaattctattgccaagttaaagtctctgcagaaggaaatggaccaacactttggtatggtagaattactgaacaacacagccaatagcttgctcagtgtctgtgagatagataaagaagttgttacagatgagaataagtcactgatccagaaggtggacatggtcactgaacaacttcacagtaagaaattctgtctggagaacatgactcagaagtttaaagaatttcaagaagtttccaaagaatctaaaaggcagcttcagtgtgcaaaggagcagctagatatccatgattcgctgggatcccaggcttacagtaacaaatacctgaccatgttgcaaactcagcagaaatcacttcaggccttgaagcatcaggtagatttggctaaaagacttgcacaggaccttgtggtagaggcctcagactcaaagggaacctctgatgttttattacaagtggaaaccatagctcaagagcatagtacactaagtcagcaggttgatgaaaagtgttctttcttagaaaccaagcttcagggcattgggcatttccagaataccattcgagaaatgttttctcagttcgcagagtttgatgatgaactggatagcatggctccagtggggagagatgcagaaacattgcaaaagcaaaaggaaactataaaagcctttctaaagaaactagaagccctcatggcaagcaatgacaatgccaataaaacctgcaagatgatgttagccacagaagaaacctctcctgaccttgttggaatcaaaagggacttggaggccttaagcaaacaatgcaacaagttactggaccgagcccaagccagagaagagcaggttgaagggacaattaagcgccttgaagaattttacagcaaattgaaagaattttctattctgctccagaaagccgaagaacatgaagagtcacaaggtcctgttggtatggaaacggagacaattaatcagcagcttaacatgttcaaggtattccagaaagaagagattgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagttctgcaagaggacatcttactcaggaaacaaaatgtagatcaggctttactaaatggtttagaactacttaaacaaaccacaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcagtttgaccaagcagctgatgctgagttatcctggattactgaaacagaaaaaaaattgatgtctctgggtgacatcaggcttgagcaagaccagacttctgctcagcttcaagttcaaaagacattcaccatggagattttgagacacaaggatattattgatgaccttgttaaatctgggcataaaatcatgaccgcatgcagtgaagaggaaaagcaatcaatgaagaaaaaactggacaaggtactgaagaactatgataccatctgccagattaattcagaaaggtatctgcagctggaacgggcacagtccctggttaaccaattctgggaaacatatgaagaactttggccatggctgacagaaacacaatcaatcatctctcagcttcccgccccagcccttgaatatgaaactctaaggcagcagcaggaagaacatcggcaactgcgtgagttgatagctgaacacaagcctcatatagataagatgaacaaaactgggccacagttactggaattgagccctggggaaggcttttctatccaagagaagtatgtggcagccgacaccctttacagtcaaattaaagaagatgtcaaaaagcgtgctgtggcactggatgaagccatttctcaatcaactcagttccatgacaagatagatcagatccttgagagcctggaacgcatcgtggaacgtctgaggcagccaccctctatctctgcagaggttgagaagatcaaggaacagatcagtgaaaataagaatgtgtcagtagacatggaaaagctacagccgttgtatgaaactcttaaacagaggggagaggaaatgattgctagatctggggggactgataaagacatatctgccaaagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagagaccataagggaagaaatagatggactacaggaggagctggatatagttattaacctaggttctgaactcattgcggcatgtggggagcctgataaacccattgtcaagaagagtatagatgagttaaattcagcatgggattctctaaataaagcttggaaagaccggattgacaaacttgaggaggcaatgcaggctgccgttcagtaccaggatggactgcaggcggtatttgactgggtagatattgcaggtggtaaattagcttcaatgtctccaattggaacagatctcgaaactgtcaagcagcagattgaagagctaaagcaatttaagtctgaggcctatcaacagcagatagaaatggaaagactgaatcatcaagcagagcttttgctaaagaaagtaacagaagagagtgacaaacacactgttcaagacccattaatggaactgaaattgatatgggatagcctggaggagagaatcatcaacagacagcataaactggagggtgctctattagccttgggtcagttccaacatgccctggatgagctcctggcatggctgacacacaccgagggcttgctaagtgagcagaaacctgttggaggagaccctaaagccattgaaattgaacttgccaagcatcatgtgctccaaaatgatgtattagcccatcagtccacagtggaagccgttaataaagcaggaaatgatctaattgaatcaagtgcaggagaagaagcaagcaaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggttcatcatcatgggagtaaaatgttacgttcggaatcaaactcttcaattactactactcagcctactatagccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcattt

SEQ ID NO: 9068 - DNA, 24269 bp, Homo sapiens
atgatcgccgcggctttcctcgtcttgctgagaccctacagcatccaatgtgccctcttcctcttgttgcttctgctgggcaccatcgccaccatcgtcttcttctgctgctggcaccgcaagctccagaaagggaggcatccgatgaaatcggtcttctcgggtcgttcaagaagccgagatgctgttttgagatcgcaccactttcgttctgagggattcagagcaagccctcggcatcttagaagacgagttgcagcggccgcagctgcccgtctggaagaagtgaagcccgtggtggaagttcaccatcagagtgagcaagaaacttcagtgaggaaacgaagaatcaagaagagcagccgagtccagccagaattttatcactctgttcaaggtgcttcaatcaggaggcctagttccgggaacgcgtcctatcgctgctctatgtcttcctctgcggatttttccgatgaggatgatttcagccagaaatctggctccgcatccccagctccgggagacaccttaccctggaatttgcctaaacatgagagatcgaaaagaaagattcaagggggctcagtgctggaccctgccgagagggcagtgcttcggatagcagatgaacgggacaaagttcagaagaaaacatttacaaaatggataaatcagcatctcatgaaggttcgaaaacatgtgaatgatctctatgaagacttaagggatggacacaatttgatttctcttttagaggttctttcaggagataccttgcccagagaaaaaggtcggatgcgttttcacagactacagaatgtacaaattgcacttgactatttgaaaagacgccaggtgaaattagtgaatattagaaatgatgacataacagatggaaatcccaaattgactttgggattaatctggacaataattttgcactttcagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggccggacctgatagatatgaatactgttgctgttcaaagcaaccttgcaaatttagagcatgctttttacgtagcagaaaaaattggtgttataagacttctggaccctgaagatgtcgatgtctcctcacctgatgaaaaatcagtaataacttacgtgtcatctctctatgatgcatttcctaaagtccctgaaggtggggaaggcattggtgcaaatgatgttgaagtcaaatggattgaataccagaatatggtgaactacctcatccaatggattagacaccatgtgaccacaatgtctgagagaacatttcctaataatcctgtagaactgaaggcactttataatcagtatttacagtttaaagaaacagaaattccaccaaaggagacagaaaaatcaaaaattaaacgtctatataaattattagagatttggatagaatttggacgcatcaagctccttcaaggttatcatccaaatgacatagaaaaagagtgggggaaactcattattgccatgctagagagagagaaggcccttcgtccagaagtagaaaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagaagtcactggaagaagaaaagaaagaacatgttgaaaaagccaaagaattgcaaaaatgggtatcaaatatcagcaagacattgaaagatgcagagaaggctggaaaacctcccttctctaagcaaaagatttccagtgaggaaatatcaaccaagaaggaacaattatcggaagcacttcaaactatacagctttttttggcaaaacatggagacaaaatgacagatgaagaaagaaatgaattggaaaaacaagtgaaaactcttcaggaaagttataatttattattcagtgaatctctgaaacagctacaagaatcacaaacctcaggagatgtaaaggtagaggagaagctggataaagtgattgcaggcaccattgatcagacaactggagaagtcctttcagtctttcaagcagttttaagaggcctcattgactatgacacaggaattaggttgcttgagacacagctaatgatttctggtctaatttcaccagaattaagaaagtgctttgaccttaaagatgccaaaagtcatggccttattgatgaacaaattctgtgccaactcaaagaactaagtaaagctaaggagattatttctgctgcgtcacctaccacaattccagtactggatgctctagctcaaagcatgataacagaatccatggccatcaaagttcttgagatactgctttctacaggctctctggttattccagccacaggagaacagttgaccctacagaaggctttccaacagaacttggtttcctcagcattattttctaaagttctggaaaggcaaaatatgtgcaaagatcttattgacccctgcacctctgagaaggtttctttaatagatatggtacaaagaagtactttacaggaaaacacagggatgtggcttctacctgtgagaccacaagaaggaggtagaataacattaaaatgtggaagaaacataagcattttaagagcagctcatgaaggtctcatagaccgtgaaaccatgtttaggttgttaagtgcacagcttctttctggaggtctgatcaattccaactctggccaaagaatgactgttgaagaagctgtcagagaaggggtgattgacagggacactgctagcagtatcctcacatatcaggttcaaactggtggaatcatccagtcaaaccctgccaagcgtttaactgtagacgaagcagtacagtgtgatttaataacttccagcagtgctcttctggtcctggaagctcagcgaggctatgttggactcatttggccccattctggtgaaatatttcccacatcatcttccttgcagcaagaattgattacaaatgaattggcctacaaaatcctgaatggcagacaaaaaatagctgctctttatattccagaaagttctcaagtcattggtttggatgctgctaaacagctaggaattatagacaacaacacagcatcaattttaaaaaatataacactgcctgataaaatgccagatttaggagatttagaagcttgtaaaaatgccagaagatggctctctttttgtaaatttcaaccctccacagttcatgattacagacaagaagaggatgtttttgatggagaagaacctgtcactactcagacctcagaagaaactaaaaaattatttctatcttatttaatgataaatagctatatggatgcaaacacagggcaaaggcttttgctgtacgatggagacttggatgaggctgttggcatgctactggaaggctgtcatgcagaatttgatggaaacacagccataaaagaatgtctcgatgtcttaagctcatctggtgtatttcttaataatgcttcaggtagagaaaaggatgaatgtacagctacaccaagtagtttcaataaatgtcactgtggagaacctgaacatgaagagactcctgaaaatagaaagtgtgctatagatgaagaatttaatgaaatgagaaatactgttatcaatagtgaattttctcagtcaggaaaactggcaagtacaatatcaattgatcctaaagttaacagttcacccagtgtgtgtgttcccagtctcatatcatatttaacacagactgaacttgcagacattagcatgcttagaagtgactctgaaaacatacttacaaactatgaaaatcaaagccgagtggaaacaaatgaacgtgcaaatgaatgtagtcattctaaaaacattcaaaactttccaagtgatttaatagaaaatcctattatgaaatcaaaaatgagtaaattctgtggtgtgaatgaaacagagaatgaagataatacaaacagggattcacctatctttgactattcccccaggctaagtgccttgttaagtcatgataaattgatgcacagtcagggaagttttaatgatacacacaccccagagagcaatggaaataagtgtgaagccccagccttatcattcagtgacaaaaccatgttgtcaggtcaaagaataggagaaaaatttcaagaccagtttctgggaattgcagctattaacatcagtttaccaggagagcagtatggacagaaatctttaaatatgatttctagtaatcctcaagtacaatatcacaatgataaatacatttcaaatacttctggtgaggatgaaaaaacacatccaggttttcagcagatgcctgaagacaaggaagatgagtctgaaatagaagagtattcctgtgctgtgactccagggggtgatactgataatgccattgtgtctcttacttgtgctacaccattgcttgatgaaaccatcagtgctagtgactatgaaacgtcactgctgaatgatcagcagaataacacaggaacagacactgatagtgatgatgatttttatgatactcccttgtttgaagatgatgaccatgattctttgcttcttgatggtgatgatcgtgattgcctgcaccctgaggactacgacacactgcaagaggaaaatgatgagacggcttctcctgctgatgttttttatgatgtctcaaaagagaatgaaaattccatggttccccagggggcaccagttggtagcttaagtgtgaagaacaaagcacattgtcttcaggatttccttatggatgttgagaaagatgaattagattctggtgaaaaaatacatttaaatcctgttggctcagataaggtgaatggacagtcactggaaactggatcagaaagggaatgcacaaatatccttgaaggtgatgaatctgactcattgactgattatgatattgtaggaggaaaagagagcttcactgcatcattaaaatttgatgacagtggcagttggagaggaagaaaggaagagtatgtaactggacaggaatttcactccgatactgatcatttagattctatgcaaagtgaagaaagttatggggattatatatatgacagtaatgatcaggatgacgatgatgatgatggcattgatgaagaaggaggaggtataagagatgagaatggaaagcccaggtgccaaaatgtggctgaagatatggatatccagttgtgtgcctctattttaaatgaaaacagtgatgaaaatgaaaatattaatacaatgattcttctggataaaatgcacagttgtagctctttagaaaaacagcaaagggtaaatgttgtacagctagcatcacctagtgaaaataacttagttactgaaaaaagcaaccttccagaatatacaactgagattgctggaaaaagcaaagaaaatctgttgaaccatgagatggtacttaaggatgtattgccgcctatcattaaagacactgaatctgaaaaaacttttggccctgcaagtatttcacatgataataataatatcagttcaacttctgaattaggtactgatctagcaaacacaaaggttaagttgattcaagggtcagaattgccagaattgactgattctgtgaaaggtaaagatgaatattttaagaatatgacaccaaaagttgactcatctcttgatcacatcatttgtactgagcctgatttaataggaaaacctgctgaggaaagccatttgtcattgatagcctctgtaactgacaaagatcctcaaggaaatggaagcgatctcattaaagggagagatggcaaaagtgatattctaatagaagatgaaacatcaattcagaaaatgtacttgggtgaaggagaagtgcttgtagaaggtctagtagaagaagaaaataggcatctcaaacttttgcctggtaaaaatacaagggatagtttcaagttaattaatagtcagtttccatttccacaaatcacaaacaatgaagaacttaatcagaaaggaagccttaaaaaagcaactgtaactcttaaagatgaaccaaataatctacaaataatagttagtaaaagtcctgttcagtttgagaatcttgaagaaatttttgacacatcagtttccaaagagattagtgatgacattacttcagacattacatcgtgggaagggaatacacattttgaggagtcattcactgatggacctgagaaagagcttgatctgtttacttacttaaaacattgtgctaaaaatataaaagcaaaagatgtagccaaaccaaatgaagatgtcccaagccatgttttaataactgcccctcccatgaaagaacatttacaattaggagttaataatacaaaagagaagtccactagtacccaaaaagactcacctcttaatgacatgatccaaagcaatgatctttgtagtaaagaaagcatctcaggaggaggaacagaaatttctcagttcacaccagaaagtattgaagccacactttcaatattatctcgtaaacatgtagaagatgttgggaaaaatgattttctgcagtcggagcggtgtgcaaatggattaggaaatgataactccagtaacactttaaatactgactattcattcttagaaattaataataagaaagaaagaattgagcaacagctaccaaaagaacaagccttgtctccaagatcccaagaaaaggaggttcagattcctgaattgtctcaggtatttgtggaggatgtaaaggatatcttaaaaagcaggttgaaagaaggtcatatgaaccctcaagaggttgaagaaccttcagcctgtgcagacactaaaattttaattcaaaatttaattaaaaggattaccacatcacagttggtaaatgaggcatctactgtgcccagcgactctcaaatgagtgactcttctggagtttcccccatgactaactcatcagaactaaagccagaaagtagagatgatcctttctgtattggaaatcttaagtctgagcttctccttaatatattgaagcaagatcaacatagccaaaaaattacaggagtatttgaattgatgagagaattaactcatatggagtatgacctagagaaaagaggcattacgtctaaagtacttccactgcagcttgaaaatattttctacaaactgcttgctgatggatattcagagaaaatagaacatgttggagactttaatcaaaaagcatgttctacatctgagatgatggaagaaaagccacatattcttggtgatattaaaagcaaagaaggaaactactattctcctaatttagaaactgtaaaagaaattggactagaaagctctactgtgtgggcatcaacattgccaagagatgagaagctcaaggatctgtgtaatgatttcccaagccatttggaatgtacttcagggtctaaagagatggcttctggagatagctcaaccgaacaattttccagtgaattacagcagtgtttacagcacactgaaaaaatgcatgagtatttgacattgcttcaagatatgaaaccccccttagacaaccaggaatctctggataacaacttggaagctttgaagaatcaacttagacagttggagacatttgaattgggattagctccaattgctgttattttaagaaaagatatgaagttggcagaagagtttttaaagtctcttcccagtgactttcccagaggccatgttgaagaattgagtattagccaccagagtttgaagaccgccttctcttccctcagcaacgtgtcttcagaaagaacgaaacagatcatgcttgcgatcgactctgaaatgtctaaactagcagtttcccatgaagaatttctgcataaacttaagtcattctcagattgggtatcagagaagagcaaatctgtgaaggatattgagattgtgaatgttcaagattctgagtatgtaaagaaacgtttggagtttctcaaggcaaataatgtattaaaagaccttggacataccaaaatgcagctggagactactgcctttgatgtgcagttcttcatttctgaatatgcacaggatctgtctcccaaccaaagcaaacaactgctgaggctcttaaatacaactcagaagtgttttcttgatgtacaggagtcagtaactacccaggtggaacgtttagagactcagttacatctagaacaagatcttgatgatcagaagattgtagcagagcgtcagcaggagtataaagagaaactccaagggatatgtgatcttcttacccaaactgaaaaccgcctaattggtcaccaagaagccttcatgattggagatggcacagttgagttaaagaaatatcagtccaagcaagaggaattacagaaagatatgcaaggaagtgcacaggcattggctgaagtagtgaaaaacacagagaacttcttaaaagagaatggtgaaaagctgtcacaggaagataaggctttgattgaacagaaacttaatgaagctaagataaagtgtgaacagcttaatttaaaagcagaacagtctaaaaaggagctggataaagttgtgacaacagcaatcaaggaagaaactgaaaaggtagcagcagtgaagcagctggaagagagcaaaaccaaaatagaaaaccttttggactggttgtcaaatgttgacaaagactcagaaagggcagggacaaaacacaaacaggtaatcgaacagaacgggacccattttcaagaaggtgatggcaagtcagcaattggagaagaggatgaagttaatggtaacctgttggagactgatgttgatgggcaagttggaaccactcaggagaatctgaatcagcaatatcagaaagttaaggcccaacacgagaagatcatctctcagcaccaagcagtgatcatagccactcagtctgcacaagtgttgcttgagaaacagggtcagtatctctctcctgaagaaaaagagaaactgcaaaagaacatgaaggaactgaaagtgcattatgaaactgcactggctgagtcagagaagaaaatgaagttaactcactctctgcaggaagaattagaaaagtttgatgctgactataccgagtttgagcactggctacagcagtcagaacaagaacttgaaaacctggaggcaggtgcagatgacatcaatggtttaatgaccaaattgaagaggcagaagagtttctcagaagacgttatttctcacaaaggtgacttgagatacatcacaatttctggaaacagagtgttggaagctgccaaatcttgcagcaagagagacggtggcaaggttgatacttctgcaacccacagagaagtgcagcgcaagttggatcatgctactgatcggttcaggtctctctactctaagtgcaatgttcttggaaataatcttaaagatctggtggataaatatcaacactatgaagatgcttcatgtggacttcttgctggactccaggcctgtgaggccacagcgagcaaacacttatctgaacctattgcggtggaccccaaaaatcttcaaaggcaattagaagagaccaaggctttgcaaggacagatatcaagtcagcaggttgctgtagagaaactgaagaaaacggctgaagtgcttttagatgccaggggatctttacttccagccaagaatgatatccagaaaacacttgatgacattgttgggagatatgaggatctgtccaagtctgttaatgaacgaaatgaaaaactccagataaccttgacccgttcactgagtgtgcaggatggcttggatgaaatgctggactggatgggaaatgtggaaagttctctgaaagaacaaggtcaagtgcctttaaactctactgctcttcaggatattatcagtaaaaacattatgttggaacaggatattgcaggtcgtcagagcagtataaatgccatgaatgaaaaagtgaagaaatttatggaaacaacagatccatccactgcatcctcactgcaagccaaaatgaaagacttgtctgctcggttttcagaagcaagtcataaacacaaagaaactcttgccaaaatggaggagctaaaaaccaaagtagaactgtttgagaacctctcagaaaagctccagacatttttagaaacaaaaactcaggctcttactgaagtagatgtgccaggaaaagatgttactgaattgtctcagtatatgcaggaatcaacttctgaatttttagaacacaagaaacatcttgaagttttgcatagtctcttgaaggagatatccagccatggcttaccaagtgataaggctttggtccttgaaaaaacaaataatttgtcaaagaaattcaaggaaatggaggataccatcaaagaaaaaaaagaagctgtaacttcttgtcaagaacagttggatgctttccaagttcttgttaaatcattgaagtcatggataaaagaaacaacaaaaaaagttcccattgtacagccttcttttggtgcagaggatttaggaaaatctttggaagacactaagaaattacaagaaaagtggagtttaaaaacaccagagattcagaaagtaaacaacagtgggatctcactatgtaacttaataagtgctgtgaccacccctgcaaaggcaatagcagcagttaaatcaggtggagcagtattaaatggtgaaggaacagccacaaatactgaggaattttgggcaaataaaggtttaacatccattaaaaaggacatgactgacataagtcatggttatgaagatcttggcctcttactcaaggacaaaatagcggaactgaacactaaactctccaaattgcaaaaggctcaggaagaatcaagtgcaatgatgcagtggttacagaaaatgaacaaaactgcaacaaaatggcagcagacacctgcacctacagatactgaagctgtgaagactcaagttgagcagaataagtcgtttgaggcagaactgaagcagaatgtaaacaaagtacaggagttgaaagacaaattgacagagctgttggaggagaacccagatactcctgaggcccccagatggaaacagatgttgacagaaatagattctaagtggcaagaactcaatcaattaacaattgatagacaacaaaaactggaagaatcctccaataatctaacccagttccagactgtagaggcccaattgaaacagtggcttgtggaaaaagaacttatggtcagtgttcttgggcccttgtcaattgacccaaatatgctaaacacacaaaggcagcaggtgcagattttgctgcaagaattcgccactcggaaacctcaatatgaacagctgacagcagctggtcagggcattctgagcaggcctggagaagacccttctttacgtgggattgtgaaagagcaactggcagctgtgacccaaaaatgggatagcctaacagggcaattgagtgacagatgtgactggattgaccaagccattgttaaaagcacacagtatcaaagcctgctgagaagcctttctgataaactgagtgacttggataataaactcagcagcagtctggctgtgagcacgcaccctgatgctatgaaccaacagttggaaacagcccaaaaaatgaagcaggagatacagcaggaaaagaagcagataaaagtggcccaggcactctgtgaggatttgtcagcactggttaaagaagagtacttgaaagcagaacttagtaggcaactagaaggcatcttaaaatcatttaaggatgttgaacagaaagcagagaatcatgtccagcaccttcagtcggcctgtgcaagctctcatcaatttcagcaaatgtctagagattttcaggcttggctggatacaaagaaagaagagcaaaacaaatctcatccaatatctgccaaactcgatgtcttggagtcattaattaaagatcataaagactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagcaggtgaaagaaagagaaaacaagttaaaagagtcattggaaaaagcccttaagtataaagagcaagtagagactctctggccatggatagacaaatgccaaaacaacctggaggaaataaaattttgcttggatcctgctgaaggagagaattctattgccaagttaaagtctctgcagaaggaaatggaccaacactttggtatggtagaattactgaacaacacagccaatagcttgctcagtgtctgtgagatagataaagaagttgttacagatgagaataagtcactgatccagaaggtggacatggtcactgaacaacttcacagtaagaaattctgtctggagaacatgactcagaagtttaaagaatttcaagaagtttccaaagaatctaaaaggcagcttcagtgtgcaaaggagcagctagatatccatgattcgctgggatcccaggcttacagtaacaaatacctgaccatgttgcaaactcagcagaaatcacttcaggccttgaagcatcaggtagatttggctaaaagacttgcacaggaccttgtggtagaggcctcagactcaaagggaacctctgatgttttattacaagtggaaaccatagctcaagagcatagtacactaagtcagcaggttgatgaaaagtgttctttcttagaaaccaagcttcagggcattgggcatttccagaataccattcgagaaatgttttctcagttcgcagagtttgatgatgaactggatagcatggctccagtggggagagatgcagaaacattgcaaaagcaaaaggaaactataaaagcctttctaaagaaactagaagccctcatggcaagcaatgacaatgccaataaaacctgcaagatgatgttagccacagaagaaacctctcctgaccttgttggaatcaaaagggacttggaggccttaagcaaacaatgcaacaagttactggaccgagcccaagccagagaagagcaggttgaagggacaattaagcgccttgaagaattttacagcaaattgaaagaattttctattctgctccagaaagccgaagaacatgaagagtcacaaggtcctgttggtatggaaacggagacaattaatcagcagcttaacatgttcaaggtattccagaaagaagagattgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagccttagaagatgacatcatcaatcacaataaacatttacaccaggctgttagcattggccagtccttaaaggttttgagctccagggaggataaagatatggtgcagagtaaattagacttctctcaagtatggtacattgagattcaagagaaaagtcacagcaggtctgagctcctccagcaggccttatgtaatgctaagatttttggggaagatgaagttgaactgatgaactggctgaatgaagtgcatgacaaactgagcaagctctcagtccaggattacagcactgaggggctatggaagcagcagtctgaacttcgggttctgcaagaggacatcttactcaggaaacaaaatgtagatcaggctttactaaatggtttagaactacttaaacaaaccacaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcagtttgaccaagcagctgatgctgagttatcctggattactgaaacagaaaaaaaattgatgtctctgggtgacatcaggcttgagcaagaccagacttctgctcagcttcaagttcaaaagacattcaccatggagattttgagacacaaggatattattgatgaccttgttaaatctgggcataaaatcatgaccgcatgcagtgaagaggaaaagcaatcaatgaagaaaaaactggacaaggtactgaagaactatgataccatctgccagattaattcagaaaggtatctgcagctggaacgggcacagtccctggttaaccaattctgggaaacatatgaagaactttggccatggctgacagaaacacaatcaatcatctctcagcttcccgccccagcccttgaatatgaaactctaaggcagcagcaggaagaacatcggcaactgcgtgagttgatagctgaacacaagcctcatatagataagatgaacaaaactgggccacagttactggaattgagccctggggaaggcttttctatccaagagaagtatgtggcagccgacaccctttacagtcaaattaaagaagatgtcaaaaagcgtgctgtggcactggatgaagccatttctcaatcaactcagttccatgacaagatagatcagatccttgagagcctggaacgcatcgtggaacgtctgaggcagccaccctctatctctgcagaggttgagaagatcaaggaacagatcagtgaaaataagaatgtgtcagtagacatggaaaagctacagccgttgtatgaaactcttaaacagaggggagaggaaatgattgctagatctggggggactgataaagacatatctgccaaagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagagaccataagggaagaaatagatggactacaggaggagctggatatagttattaacctaggttctgaactcattgcggcatgtggggagcctgataaacccattgtcaagaagagtatagatgagttaaattcagcatgggattctctaaataaagcttggaaagaccggattgacaaacttgaggaggcaatgcaggctgccgttcagtaccaggatggactgcaggcggtatttgactgggtagatattgcaggtggtaaattagcttcaatgtctccaattggaacagatctcgaaactgtcaagcagcagattgaagagctaaagcaatttaagtctgaggcctatcaacagcagatagaaatggaaagactgaatcatcaagcagagcttttgctaaagaaagtaacagaagagagtgacaaacacactgttcaagacccattaatggaactgaaattgatatgggatagcctggaggagagaatcatcaacagacagcataaactggagggtgctctattagccttgggtcagttccaacatgccctggatgagctcctggcatggctgacacacaccgagggcttgctaagtgagcagaaacctgttggaggagaccctaaagccattgaaattgaacttgccaagcatcatgtgctccaaaatgatgtattagcccatcagtccacagtggaagccgttaataaagcaggaaatgatctaattgaatcaagtgcaggagaagaagcaagcaaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacagggtaagttttcaaagtaattttggagactcccagcaactgcgactggtccggatcctgcggagtactgtgatggttcgtgttggaggtggatggatggcacttgatgagttcttagtgaaaaatgatccttgcagggttcatcatcatgggagtaaaatgttacgttcggaatcaaactcttcaattactactactcagcctactatagccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatgg

SEQ ID NO: 9069 - DNA, 8999 bp, Homo sapiens
aatattcagctgccacttttcaccgttagaagtagagctttttccagacctcctaccttttagtctactttgaaaggtgaaagaaagaacatcgtttcaggaataaaaatgcacagtagtagttatagttaccgtagcagtgattctgtgtttagtaacactaccagcactcgaaccagtcttgattcaaatgaaaatcttctcttggttcattgtggtccaacactgatcaactcttgcattagcttcggcagtgaatcctttgatggacacaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagattaaaaggtgtaaggagacttctgaacatggggcatattcagatctgcttcagcgtcagaaggcaacagtgcttgagaatagcaaacttacaggaaagataagtgagttggaaagaatggtagctgaactaaagaaacaaaagtcccgagtagaggaagaacttccgaaggtcagggaggctgcagaaaatgaattgagaaagcagcagagaaatgtagaagatatctctctgcagaagataagggctgaaagtgaagccaagcagtaccgcagggaacttgaaaccattgtgagagagaaggaagccgctgaaagagaactggagcgggtgaggcagctcaccatagaggccgaggctaaaagagctgccgtggaagagaacctcctgaattttcgcaatcagttggaggaaaacacctttaccagacgaacactggaagatcatcttaaaagaaaagatttaagtctcaatgatttggagcaacaaaaaaataaattaatggaagaattaagaagaaagagagacaatgaggaagaactcttgaagctgataaagcagatggaaaaagaccttgcatttcagaaacaggtagcagagaaacagttgaaagaaaagcagaaaattgaattggaagcaagaagaaaaataactgaaattcagtatacatgtagagaaaatgcattgccagtgtgtccgatcacacaggctacatcatgcagggcagtaacgggtctccagcaagaacatgacaagcagaaagcagaagaactcaaacagcaggtagatgaactaacagctgccaatagaaaggctgaacaagacatgagagagctgacatatgaacttaatgccctccagcttgaaaaaacgtcatctgaggaaaaggctcgtttgctaaaagataaactagatgaaacaaataatacactcagatgccttaagttggagctggaaaggaaggatcaggcggagaaagggtattctcaacaactcagagagcttggtaggcaattgaatcaaaccacaggtaaagctgaagaagccatgcaagaagctagtgatctcaagaaaataaagcgcaattatcagttagaattagaatctcttaatcatgaaaaagggaaactacaaagagaagtagacagaatcacaagggcacatgctgtagctgagaagaatattcagcatttaaattcacaaattcattcttttcgagatgagaaagaattagaaagactacaaatctgccagagaaaatcagatcatctaaaagaacaatttgagaaaagccatgagcagttgcttcaaaatatcaaagctgaaaaagaaaataatgataaaatccaaaggctcaatgaagaattggagaaaagtaatgagtgtgcagagatgctaaaacaaaaagtagaggagcttactaggcagaataatgaaaccaaattaatgatgcagagaattcaggcagaatcagagaatatagttttagagaaacaaactatccagcaaagatgtgaagcactgaaaattcaggcagatggttttaaagatcagctacgcagcacaaatgaacacttgcataaacagacaaaaacagagcaggattttcaaagaaaaattaaatgcctagaagaagacctggcgaaaagtcaaaatttggtaagtgaatttaagcaaaagtgtgaccaacagaacattatcatccagaataccaagaaagaagttagaaatctgaatgcggaactgaatgcttccaaagaagagaagcgacgcggggagcagaaagttcagctacaacaagctcaggtgcaagagttaaataacaggttgaaaaaagtacaagacgaattacacttaaagaccatagaggagcagatgacccacagaaagatggttctgtttcaggaagaatctggtaaattcaaacaatcagcagaggagtttcggaagaagatggaaaaattaatggagtccaaagtcatcactgaaaatgatatttcaggcattaggcttgactttgtgtctcttcaacaagaaaactctagagcccaagaaaatgctaagctttgtgaaacaaacattaaagaacttgaaagacagcttcaacagtatcgtgaacaaatgcagcaagggcagcacatggaagcaaatcattaccaaaaatgtcagaaacttgaggatgagctgatagcccagaagcgtgaggttgaaaacctgaagcaaaaaatggaccaacagatcaaagagcatgaacatcaattagttttgctccagtgtgaaattcaaaaaaagagcacagccaaagactgtaccttcaaaccagattttgagatgacagtgaaggagtgccagcactctggagagctgtcctctagaaacactggacaccttcacccaacacccagatcccctctgttgagatggactcaagaaccacagccattggaagagaagtggcagcatcgggttgttgaacagatacccaaagaagtccaattccagccaccaggggctccactcgagaaagagaaaagccagcagtgttactctgagtacttttctcagacaagcaccgagttacagataacttttgatgagacaaaccccattacaagactgtctgaaattgagaagataagagaccaagccctgaacaattctagaccacctgttaggtatcaagataacgcatgtgaaatggaactggtgaaggttttgacacccttagagatagctaagaacaagcagtatgatatgcatacagaagtcacaacattaaaacaagaaaagaacccagttcccagtgctgaagaatggatgcttgaagggtgcagagcatctggtggactcaagaaaggggatttccttaagaagggcttagaaccagagaccttccagaactttgatggtgatcatgcatgttcagtcagggatgatgaatttaaattccaagggcttaggcacactgtgactgccaggcagttggtggaagctaagcttctggacatgagaacaattgagcagctgcgactcggtcttaagactgttgaagaagttcagaaaactcttaacaagtttctgacgaaagccacctcaattgcagggctttacctagaatctacaaaagaaaagatttcatttgcctcagcggccgagagaatcataatagacaaaatggtggctttggcatttttagaagctcaggctgcaacaggttttataattgatcccatttcaggtcagacatattctgttgaagatgcagttcttaaaggagttgttgaccccgaattcagaattaggcttcttgaggcagagaaggcagctgtgggatattcttattcttctaagacattgtcagtgtttcaagctatggaaaatagaatgcttgacagacaaaaaggtaaacatatcttggaagcccagattgccagtgggggtgtcattgaccctgtgagaggcattcgtgttcctccagaaattgctctgcagcaggggttgttgaataatgccatcttacagtttttacatgagccatccagcaacacaagagttttccctaatcccaataacaagcaagctctgtattactcagaattactgcgaatgtgtgtatttgatgtagagtcccaatgctttctgtttccatttggggagaggaacatttccaatctcaatgtcaagaaaacacatagaatttctgtagtagatactaaaacaggatcagaattgaccgtgtatgaggctttccagagaaacctgattgagaaaagtatatatcttgaactttcagggcagcaatatcagtggaaggaagctatgttttttgaatcctatgggcattcttctcatatgctgactgatactaaaacaggattacacttcaatattaatgaggctatagagcagggaacaattgacaaagccttggtcaaaaagtatcaggaaggcctcatcacacttacagaacttgctgattctttgctgagccggttagtccccaagaaagatttgcacagtcctgttgcagggtattggctgactgctagtggggaaaggatctctgtactaaaagcctcccgtagaaatttggttgatcggattactgccctccgatgccttgaagcccaagtcagtacagggggcataattgatcctcttactggcaaaaagtaccgggtggccgaagctttgcatagaggcctggttgatgaggggtttgcccagcagctgcgacagtgtgaattagtaatcacagggattggccatcccatcactaacaaaatgatgtcagtggtggaagctgtgaatgcaaatattataaataaggaaatgggaatccgatgtttggaatttcagtacttgacaggagggttgatagagccacaggttcactctcggttatcaatagaagaggctctccaagtaggtattatagatgtcctcattgccacaaaactcaaagatcaaaagtcatatgtcagaaatataatatgccctcagacaaaaagaaagttgacatataaagaagccttagaaaaagctgattttgatttccacacaggacttaaactgttagaagtatctgagcccctgatgacaggaatttctagcctctactattcttcctaatgggacatgtttaaataactgtgcaaggggtgatgcaggctggttcatgccactttttcagagtatgatgatatcggctacatatgcagtctgtgaattatgtaacatactctatttcttgagggctgcaaattgctaagtgctcaaaatagagtaagttttaaattgaaaattacataagatttaatgcccttcaaatggtttcatttagccttgagaatggttttttgaaacttggccacactaaaatgtttttttttttacgtagaatgtgggataaacttgatgaactccaagttcacagtgtcatttcttcagaactccccttcattgaatagtgatcatttattaaatgataaattgcactcgctgaaagagcacgtcatgaagcaccatggaatcaaagagaaagatataaattcgttcccacagccttcaagctgcagtgttttagattgcttcaaaaaatgaaaaagttttgcctttttctgtatatagtgaccttctttgcatattaaaatgtttaccacaatgtcccatttctagttaagtcttcgcacttgaaagctaacattatgaatattatgtgttggaggaggggaaggattttcttcattctgtgtattttccttacatgtacagtagacgttctctattctatcagccttctatggtacctttttgtcaggacaattaggattgtaatgctaatgcaaaggcagcaattcaaagatcttctagtgcctcatgaataaagttgagatttaaaatttgtaacattgatggaacagctgggaggttagaccaatcattaaggaatgtatgccatagctttctttgctaccataaacattttggaggtgcatctgctatgtgacatggtaaatatggttaagtgaatgaataaaatgttttagtaacctgtgtgtgatgaaaaaaaa

SEQ ID NO: 9070 - DNA, 23735 bp, Homo sapiens
atggcgggttacctctcccctgctgcttacctgtacgtggaggagcaggagtatctccaggcctacgaggatgtcctggagaggtacaaagatgaacgggacaaagttcagaagaaaacatttacaaaatggataaatcagcatctcatgaaggttcgaaaacatgtgaatgatctctatgaagacttaagggatggacacaatttgatttctcttttagaggttctttcaggagataccttgcccagagaaaaaggtcggatgcgttttcacagactacagaatgtacaaattgcacttgactatttgaaaagacgccaggtgaaattagtgaatattagaaatgatgacataacagatggaaatcccaaattgactttgggattaatctggacaataattttgcactttcagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggccggacctgatagatatgaatactgttgctgttcaaagcaaccttgcaaatttagagcatgctttttacgtagcagaaaaaattggtgttataagacttctggaccctgaagatgtcgatgtctcctcacctgatgaaaaatcagtaataacttacgtgtcatctctctatgatgcatttcctaaagtccctgaaggtggggaaggcattggtgcaaatgatgttgaagtcaaatggattgaataccagaatatggtgaactacctcatccaatggattagacaccatgtgaccacaatgtctgagagaacatttcctaataatcctgtagaactgaaggcactttataatcagtatttacagtttaaagaaacagaaattccaccaaaggagacagaaaaatcaaaaattaaacgtctatataaattattagagatttggatagaatttggacgcatcaagctccttcaaggttatcatccaaatgacatagaaaaagagtgggggaaactcattattgccatgctagagagagagaaggcccttcgtccagaagtagaaaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagaagtcactggaagaagaaaagaaagaacatgttgaaaaagccaaagaattgcaaaaatgggtatcaaatatcagcaagacattgaaagatgcagagaaggctggaaaacctcccttctctaagcaaaagatttccagtgaggaaatatcaaccaagaaggaacaattatcggaagcacttcaaactatacagctttttttggcaaaacatggagacaaaatgacagatgaagaaagaaatgaattggaaaaacaagtgaaaactcttcaggaaagttataatttattattcagtgaatctctgaaacagctacaagaatcacaaacctcaggagatgtaaaggtagaggagaagctggataaagtgattgcaggcaccattgatcagacaactggagaagtcctttcagtctttcaagcagttttaagaggcctcattgactatgacacaggaattaggttgcttgagacacagctaatgatttctggtctaatttcaccagaattaagaaagtgctttgaccttaaagatgccaaaagtcatggccttattgatgaacaaattctgtgccaactcaaagaactaagtaaagctaaggagattatttctgctgcgtcacctaccacaattccagtactggatgctctagctcaaagcatgataacagaatccatggccatcaaagttcttgagatactgctttctacaggctctctggttattccagccacaggagaacagttgaccctacagaaggctttccaacagaacttggtttcctcagcattattttctaaagttctggaaaggcaaaatatgtgcaaagatcttattgacccctgcacctctgagaaggtttctttaatagatatggtacaaagaagtactttacaggaaaacacagggatgtggcttctacctgtgagaccacaagaaggaggtagaataacattaaaatgtggaagaaacataagcattttaagagcagctcatgaaggtctcatagaccgtgaaaccatgtttaggttgttaagtgcacagcttctttctggaggtctgatcaattccaactctggccaaagaatgactgttgaagaagctgtcagagaaggggtgattgacagggacactgctagcagtatcctcacatatcaggttcaaactggtggaatcatccagtcaaaccctgccaagcgtttaactgtagacgaagcagtacagtgtgatttaataacttccagcagtgctcttctggtcctggaagctcagcgaggctatgttggactcatttggccccattctggtgaaatatttcccacatcatcttccttgcagcaagaattgattacaaatgaattggcctacaaaatcctgaatggcagacaaaaaatagctgctctttatattccagaaagttctcaagtcattggtttggatgctgctaaacagctaggaattatagacaacaacacagcatcaattttaaaaaatataacactgcctgataaaatgccagatttaggagatttagaagcttgtaaaaatgccagaagatggctctctttttgtaaatttcaaccctccacagttcatgattacagacaagaagaggatgtttttgatggagaagaacctgtcactactcagacctcagaagaaactaaaaaattatttctatcttatttaatgataaatagctatatggatgcaaacacagggcaaaggcttttgctgtacgatggagacttggatgaggctgttggcatgctactggaaggctgtcatgcagaatttgatggaaacacagccataaaagaatgtctcgatgtcttaagctcatctggtgtatttcttaataatgcttcaggtagagaaaaggatgaatgtacagctacaccaagtagtttcaataaatgtcactgtggagaacctgaacatgaagagactcctgaaaatagaaagtgtgctatagatgaagaatttaatgaaatgagaaatactgttatcaatagtgaattttctcagtcaggaaaactggcaagtacaatatcaattgatcctaaagttaacagttcacccagtgtgtgtgttcccagtctcatatcatatttaacacagactgaacttgcagacattagcatgcttagaagtgactctgaaaacatacttacaaactatgaaaatcaaagccgagtggaaacaaatgaacgtgcaaatgaatgtagtcattctaaaaacattcaaaactttccaagtgatttaatagaaaatcctattatgaaatcaaaaatgagtaaattctgtggtgtgaatgaaacagagaatgaagataatacaaacagggattcacctatctttgactattcccccaggctaagtgccttgttaagtcatgataaattgatgcacagtcagggaagttttaatgatacacacaccccagagagcaatggaaataagtgtgaagccccagccttatcattcagtgacaaaaccatgttgtcaggtcaaagaataggagaaaaatttcaagaccagtttctgggaattgcagctattaacatcagtttaccaggagagcagtatggacagaaatctttaaatatgatttctagtaatcctcaagtacaatatcacaatgataaatacatttcaaatacttctggtgaggatgaaaaaacacatccaggttttcagcagatgcctgaagacaaggaagatgagtctgaaatagaagagtattcctgtgctgtgactccagggggtgatactgataatgccattgtgtctcttacttgtgctacaccattgcttgatgaaaccatcagtgctagtgactatgaaacgtcactgctgaatgatcagcagaataacacaggaacagacactgatagtgatgatgatttttatgatactcccttgtttgaagatgatgaccatgattctttgcttcttgatggtgatgatcgtgattgcctgcaccctgaggactacgacacactgcaagaggaaaatgatgagacggcttctcctgctgatgttttttatgatgtctcaaaagagaatgaaaattccatggttccccagggggcaccagttggtagcttaagtgtgaagaacaaagcacattgtcttcaggatttccttatggatgttgagaaagatgaattagattctggtgaaaaaatacatttaaatcctgttggctcagataaggtgaatggacagtcactggaaactggatcagaaagggaatgcacaaatatccttgaaggtgatgaatctgactcattgactgattatgatattgtaggaggaaaagagagcttcactgcatcattaaaatttgatgacagtggcagttggagaggaagaaaggaagagtatgtaactggacaggaatttcactccgatactgatcatttagattctatgcaaagtgaagaaagttatggggattatatatatgacagtaatgatcaggatgacgatgatgatgatggcattgatgaagaaggaggaggtataagagatgagaatggaaagcccaggtgccaaaatgtggctgaagatatggatatccagttgtgtgcctctattttaaatgaaaacagtgatgaaaatgaaaatattaatacaatgattcttctggataaaatgcacagttgtagctctttagaaaaacagcaaagggtaaatgttgtacagctagcatcacctagtgaaaataacttagttactgaaaaaagcaaccttccagaatatacaactgagattgctggaaaaagcaaagaaaatctgttgaaccatgagatggtacttaaggatgtattgccgcctatcattaaagacactgaatctgaaaaaacttttggccctgcaagtatttcacatgataataataatatcagttcaacttctgaattaggtactgatctagcaaacacaaaggttaagttgattcaagggtcagaattgccagaattgactgattctgtgaaaggtaaagatgaatattttaagaatatgacaccaaaagttgactcatctcttgatcacatcatttgtactgagcctgatttaataggaaaacctgctgaggaaagccatttgtcattgatagcctctgtaactgacaaagatcctcaaggaaatggaagcgatctcattaaagggagagatggcaaaagtgatattctaatagaagatgaaacatcaattcagaaaatgtacttgggtgaaggagaagtgcttgtagaaggtctagtagaagaagaaaataggcatctcaaacttttgcctggtaaaaatacaagggatagtttcaagttaattaatagtcagtttccatttccacaaatcacaaacaatgaagaacttaatcagaaaggaagccttaaaaaagcaactgtaactcttaaagatgaaccaaataatctacaaataatagttagtaaaagtcctgttcagtttgagaatcttgaagaaatttttgacacatcagtttccaaagagattagtgatgacattacttcagacattacatcgtgggaagggaatacacattttgaggagtcattcactgatggacctgagaaagagcttgatctgtttacttacttaaaacattgtgctaaaaatataaaagcaaaagatgtagccaaaccaaatgaagatgtcccaagccatgttttaataactgcccctcccatgaaagaacatttacaattaggagttaataatacaaaagagaagtccactagtacccaaaaagactcacctcttaatgacatgatccaaagcaatgatctttgtagtaaagaaagcatctcaggaggaggaacagaaatttctcagttcacaccagaaagtattgaagccacactttcaatattatctcgtaaacatgtagaagatgttgggaaaaatgattttctgcagtcggagcggtgtgcaaatggattaggaaatgataactccagtaacactttaaatactgactattcattcttagaaattaataataagaaagaaagaattgagcaacagctaccaaaagaacaagccttgtctccaagatcccaagaaaaggaggttcagattcctgaattgtctcaggtatttgtggaggatgtaaaggatatcttaaaaagcaggttgaaagaaggtcatatgaaccctcaagaggttgaagaaccttcagcctgtgcagacactaaaattttaattcaaaatttaattaaaaggattaccacatcacagttggtaaatgaggcatctactgtgcccagcgactctcaaatgagtgactcttctggagtttcccccatgactaactcatcagaactaaagccagaaagtagagatgatcctttctgtattggaaatcttaagtctgagcttctccttaatatattgaagcaagatcaacatagccaaaaaattacaggagtatttgaattgatgagagaattaactcatatggagtatgacctagagaaaagaggcattacgtctaaagtacttccactgcagcttgaaaatattttctacaaactgcttgctgatggatattcagagaaaatagaacatgttggagactttaatcaaaaagcatgttctacatctgagatgatggaagaaaagccacatattcttggtgatattaaaagcaaagaaggaaactactattctcctaatttagaaactgtaaaagaaattggactagaaagctctactgtgtgggcatcaacattgccaagagatgagaagctcaaggatctgtgtaatgatttcccaagccatttggaatgtacttcagggtctaaagagatggcttctggagatagctcaaccgaacaattttccagtgaattacagcagtgtttacagcacactgaaaaaatgcatgagtatttgacattgcttcaagatatgaaaccccccttagacaaccaggaatctctggataacaacttggaagctttgaagaatcaacttagacagttggagacatttgaattgggattagctccaattgctgttattttaagaaaagatatgaagttggcagaagagtttttaaagtctcttcccagtgactttcccagaggccatgttgaagaattgagtattagccaccagagtttgaagaccgccttctcttccctcagcaacgtgtcttcagaaagaacgaaacagatcatgcttgcgatcgactctgaaatgtctaaactagcagtttcccatgaagaatttctgcataaacttaagtcattctcagattgggtatcagagaagagcaaatctgtgaaggatattgagattgtgaatgttcaagattctgagtatgtaaagaaacgtttggagtttctcaaggcaaataatgtattaaaagaccttggacataccaaaatgcagctggagactactgcctttgatgtgcagttcttcatttctgaatatgcacaggatctgtctcccaaccaaagcaaacaactgctgaggctcttaaatacaactcagaagtgttttcttgatgtacaggagtcagtaactacccaggtggaacgtttagagactcagttacatctagaacaagatcttgatgatcagaagattgtagcagagcgtcagcaggagtataaagagaaactccaagggatatgtgatcttcttacccaaactgaaaaccgcctaattggtcaccaagaagccttcatgattggagatggcacagttgagttaaagaaatatcagtccaagcaagaggaattacagaaagatatgcaaggaagtgcacaggcattggctgaagtagtgaaaaacacagagaacttcttaaaagagaatggtgaaaagctgtcacaggaagataaggctttgattgaacagaaacttaatgaagctaagataaagtgtgaacagcttaatttaaaagcagaacagtctaaaaaggagctggataaagttgtgacaacagcaatcaaggaagaaactgaaaaggtagcagcagtgaagcagctggaagagagcaaaaccaaaatagaaaaccttttggactggttgtcaaatgttgacaaagactcagaaagggcagggacaaaacacaaacaggtaatcgaacagaacgggacccattttcaagaaggtgatggcaagtcagcaattggagaagaggatgaagttaatggtaacctgttggagactgatgttgatgggcaagttggaaccactcaggagaatctgaatcagcaatatcagaaagttaaggcccaacacgagaagatcatctctcagcaccaagcagtgatcatagccactcagtctgcacaagtgttgcttgagaaacagggtcagtatctctctcctgaagaaaaagagaaactgcaaaagaacatgaaggaactgaaagtgcattatgaaactgcactggctgagtcagagaagaaaatgaagttaactcactctctgcaggaagaattagaaaagtttgatgctgactataccgagtttgagcactggctacagcagtcagaacaagaacttgaaaacctggaggcaggtgcagatgacatcaatggtttaatgaccaaattgaagaggcagaagagtttctcagaagacgttatttctcacaaaggtgacttgagatacatcacaatttctggaaacagagtgttggaagctgccaaatcttgcagcaagagagacggtggcaaggttgatacttctgcaacccacagagaagtgcagcgcaagttggatcatgctactgatcggttcaggtctctctactctaagtgcaatgttcttggaaataatcttaaagatctggtggataaatatcaacactatgaagatgcttcatgtggacttcttgctggactccaggcctgtgaggccacagcgagcaaacacttatctgaacctattgcggtggaccccaaaaatcttcaaaggcaattagaagagaccaaggctttgcaaggacagatatcaagtcagcaggttgctgtagagaaactgaagaaaacggctgaagtgcttttagatgccaggggatctttacttccagccaagaatgatatccagaaaacacttgatgacattgttgggagatatgaggatctgtccaagtctgttaatgaacgaaatgaaaaactccagataaccttgacccgttcactgagtgtgcaggatggcttggatgaaatgctggactggatgggaaatgtggaaagttctctgaaagaacaaggtcaagtgcctttaaactctactgctcttcaggatattatcagtaaaaacattatgttggaacaggatattgcaggtcgtcagagcagtataaatgccatgaatgaaaaagtgaagaaatttatggaaacaacagatccatccactgcatcctcactgcaagccaaaatgaaagacttgtctgctcggttttcagaagcaagtcataaacacaaagaaactcttgccaaaatggaggagctaaaaaccaaagtagaactgtttgagaacctctcagaaaagctccagacatttttagaaacaaaaactcaggctcttactgaagtagatgtgccaggaaaagatgttactgaattgtctcagtatatgcaggaatcaacttctgaatttttagaacacaagaaacatcttgaagttttgcatagtctcttgaaggagatatccagccatggcttaccaagtgataaggctttggtccttgaaaaaacaaataatttgtcaaagaaattcaaggaaatggaggataccatcaaagaaaaaaaagaagctgtaacttcttgtcaagaacagttggatgctttccaagttcttgttaaatcattgaagtcatggataaaagaaacaacaaaaaaagttcccattgtacagccttcttttggtgcagaggatttaggaaaatctttggaagacactaagaaattacaagaaaagtggagtttaaaaacaccagagattcagaaagtaaacaacagtgggatctcactatgtaacttaataagtgctgtgaccacccctgcaaaggcaatagcagcagttaaatcaggtggagcagtattaaatggtgaaggaacagccacaaatactgaggaattttgggcaaataaaggtttaacatccattaaaaaggacatgactgacataagtcatggttatgaagatcttggcctcttactcaaggacaaaatagcggaactgaacactaaactctccaaattgcaaaaggctcaggaagaatcaagtgcaatgatgcagtggttacagaaaatgaacaaaactgcaacaaaatggcagcagacacctgcacctacagatactgaagctgtgaagactcaagttgagcagaataagtcgtttgaggcagaactgaagcagaatgtaaacaaagtacaggagttgaaagacaaattgacagagctgttggaggagaacccagatactcctgaggcccccagatggaaacagatgttgacagaaatagattctaagtggcaagaactcaatcaattaacaattgatagacaacaaaaactggaagaatcctccaataatctaacccagttccagactgtagaggcccaattgaaacagtggcttgtggaaaaagaacttatggtcagtgttcttgggcccttgtcaattgacccaaatatgctaaacacacaaaggcagcaggtgcagattttgctgcaagaattcgccactcggaaacctcaatatgaacagctgacagcagctggtcagggcattctgagcaggcctggagaagacccttctttacgtgggattgtgaaagagcaactggcagctgtgacccaaaaatgggatagcctaacagggcaattgagtgacagatgtgactggattgaccaagccattgttaaaagcacacagtatcaaagcctgctgagaagcctttctgataaactgagtgacttggataataaactcagcagcagtctggctgtgagcacgcaccctgatgctatgaaccaacagttggaaacagcccaaaaaatgaagcaggagatacagcaggaaaagaagcagataaaagtggcccaggcactctgtgaggatttgtcagcactggttaaagaagagtacttgaaagcagaacttagtaggcaactagaaggcatcttaaaatcatttaaggatgttgaacagaaagcagagaatcatgtccagcaccttcagtcggcctgtgcaagctctcatcaatttcagcaaatgtctagagattttcaggcttggctggatacaaagaaagaagagcaaaacaaatctcatccaatatctgccaaactcgatgtcttggagtcattaattaaagatcataaagactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagcaggtgaaagaaagagaaaacaagttaaaagagtcattggaaaaagcccttaagtataaagagcaagtagagactctctggccatggatagacaaatgccaaaacaacctggaggaaataaaattttgcttggatcctgctgaaggagagaattctattgccaagttaaagtctctgcagaaggaaatggaccaacactttggtatggtagaattactgaacaacacagccaatagcttgctcagtgtctgtgagatagataaagaagttgttacagatgagaataagtcactgatccagaaggtggacatggtcactgaacaacttcacagtaagaaattctgtctggagaacatgactcagaagtttaaagaatttcaagaagtttccaaagaatctaaaaggcagcttcagtgtgcaaaggagcagctagatatccatgattcgctgggatcccaggcttacagtaacaaatacctgaccatgttgcaaactcagcagaaatcacttcaggccttgaagcatcaggtagatttggctaaaagacttgcacaggaccttgtggtagaggcctcagactcaaagggaacctctgatgttttattacaagtggaaaccatagctcaagagcatagtacactaagtcagcaggttgatgaaaagtgttctttcttagaaaccaagcttcagggcattgggcatttccagaataccattcgagaaatgttttctcagttcgcagagtttgatgatgaactggatagcatggctccagtggggagagatgcagaaacattgcaaaagcaaaaggaaactataaaagcctttctaaagaaactagaagccctcatggcaagcaatgacaatgccaataaaacctgcaagatgatgttagccacagaagaaacctctcctgaccttgttggaatcaaaagggacttggaggccttaagcaaacaatgcaacaagttactggaccgagcccaagccagagaagagcaggttgaagggacaattaagcgccttgaagaattttacagcaaattgaaagaattttctattctgctccagaaagccgaagaacatgaagagtcacaaggtcctgttggtatggaaacggagacaattaatcagcagcttaacatgttcaaggtattccagaaagaagagattgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagccttagaagatgacatcatcaatcacaataaacatttacaccaggctgttagcattggccagtccttaaaggttttgagctccagggaggataaagatatggtgcagagtaaattagacttctctcaagtatggtacattgagattcaagagaaaagtcacagcaggtctgagctcctccagcaggccttatgtaatgctaagatttttggggaagatgaagttgaactgatgaactggctgaatgaagtgcatgacaaactgagcaagctctcagtccaggattacagcactgaggggctatggaagcagcagtctgaacttcgggttctgcaagaggacatcttactcaggaaacaaaatgtagatcaggctttactaaatggtttagaactacttaaacaaaccacaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcagtttgaccaagcagctgatgctgagttatcctggattactgaaacagaaaaaaaattgatgtctctgggtgacatcaggcttgagcaagaccagacttctgctcagcttcaagttcaaaagacattcaccatggagattttgagacacaaggatattattgatgaccttgttaaatctgggcataaaatcatgaccgcatgcagtgaagaggaaaagcaatcaatgaagaaaaaactggacaaggtactgaagaactatgataccatctgccagattaattcagaaaggtatctgcagctggaacgggcacagtccctggttaaccaattctgggaaacatatgaagaactttggccatggctgacagaaacacaatcaatcatctctcagcttcccgccccagcccttgaatatgaaactctaaggcagcagcaggaagaacatcggcaactgcgtgagttgatagctgaacacaagcctcatatagataagatgaacaaaactgggccacagttactggaattgagccctggggaaggcttttctatccaagagaagtatgtggcagccgacaccctttacagtcaaattaaagaagatgtcaaaaagcgtgctgtggcactggatgaagccatttctcaatcaactcagttccatgacaagatagatcagatccttgagagcctggaacgcatcgtggaacgtctgaggcagccaccctctatctctgcagaggttgagaagatcaaggaacagatcagtgaaaataagaatgtgtcagtagacatggaaaagctacagccgttgtatgaaactcttaaacagaggggagaggaaatgattgctagatctggggggactgataaagacatatctgccaaagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagagaccataagggaagaaatagatggactacaggaggagctggatatagttattaacctaggttctgaactcattgcggcatgtggggagcctgataaacccattgtcaagaagagtatagatgagttaaattcagcatgggattctctaaataaagcttggaaagaccggattgacaaacttgaggaggcaatgcaggctgccgttcagtaccaggatggactgcaggcggtatttgactgggtagatattgcaggtggtaaattagcttcaatgtctccaattggaacagatctcgaaactgtcaagcagcagattgaagagctaaagcaatttaagtctgaggcctatcaacagcagatagaaatggaaagactgaatcatcaagcagagcttttgctaaagaaagtaacagaagagagtgacaaacacactgttcaagacccattaatggaactgaaattgatatgggatagcctggaggagagaatcatcaacagacagcataaactggagggtgctctattagccttgggtcagttccaacatgccctggatgagctcctggcatggctgacacacaccgagggcttgctaagtgagcagaaacctgttggaggagaccctaaagccattgaaattgaacttgccaagcatcatgtgctccaaaatgatgtattagcccatcagtccacagtggaagccgttaataaagcaggaaatgatctaattgaatcaagtgcaggagaagaagcaagcaaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacagggtaagttttcaaagtaattttggagactcccagcaactgcgactggtccggatcctgcggagtactgtgatggttcgtgttggaggtggatggatggcacttgatgagttcttagtgaaaaatgatccttgcagggttcatcatcatgggagtaaaatgttacgttcggaatcaaactcttcaattactactactcagcctactatagccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatgg

SEQ ID NO: 9071 - DNA, 17390 bp, Homo sapiens
atggcgggttacctctcccctgctgcttacctgtacgtggaggagcaggagtatctccaggcctacgaggatgtcctggagaggtacaaagatgaacgggacaaagttcagaagaaaacatttacaaaatggataaatcagcatctcatgaaggttcgaaaacatgtgaatgatctctatgaagacttaagggatggacacaatttgatttctcttttagaggttctttcaggagataccttgcccagagaaaaaggtcggatgcgttttcacagactacagaatgtacaaattgcacttgactatttgaaaagacgccaggtgaaattagtgaatattagaaatgatgacataacagatggaaatcccaaattgactttgggattaatctggacaataattttgcactttcagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggccggacctgatagatatgaatactgttgctgttcaaagcaaccttgcaaatttagagcatgctttttacgtagcagaaaaaattggtgttataagacttctggaccctgaagatgtcgatgtctcctcacctgatgaaaaatcagtaataacttacgtgtcatctctctatgatgcatttcctaaagtccctgaaggtggggaaggcattggtgcaaatgatgttgaagtcaaatggattgaataccagaatatggtgaactacctcatccaatggattagacaccatgtgaccacaatgtctgagagaacatttcctaataatcctgtagaactgaaggcactttataatcagtatttacagtttaaagaaacagaaattccaccaaaggagacagaaaaatcaaaaattaaacgtctatataaattattagagatttggatagaatttggacgcatcaagctccttcaaggttatcatccaaatgacatagaaaaagagtgggggaaactcattattgccatgctagagagagagaaggcccttcgtccagaagtagaaaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagaagtcactggaagaagaaaagaaagaacatgttgaaaaagccaaagaattgcaaaaatgggtatcaaatatcagcaagacattgaaagatgcagagaaggctggaaaacctcccttctctaagcaaaagatttccagtgaggaaatatcaaccaagaaggaacaattatcggaagcacttcaaactatacagctttttttggcaaaacatggagacaaaatgacagatgaagaaagaaatgaattggaaaaacaagtgaaaactcttcaggaaagttataatttattattcagtgaatctctgaaacagctacaagaatcacaaacctcaggagatgtaaaggtagaggagaagattgtagcagagcgtcagcaggagtataaagagaaactccaagggatatgtgatcttcttacccaaactgaaaaccgcctaattggtcaccaagaagccttcatgattggagatggcacagttgagttaaagaaatatcagtccaagcaagaggaattacagaaagatatgcaaggaagtgcacaggcattggctgaagtagtgaaaaacacagagaacttcttaaaagagaatggtgaaaagctgtcacaggaagataaggctttgattgaacagaaacttaatgaagctaagataaagtgtgaacagcttaatttaaaagcagaacagtctaaaaaggagctggataaagttgtgacaacagcaatcaaggaagaaactgaaaaggtagcagcagtgaagcagctggaagagagcaaaaccaaaatagaaaaccttttggactggttgtcaaatgttgacaaagactcagaaagggcagggacaaaacacaaacaggtaatcgaacagaacgggacccattttcaagaaggtgatggcaagtcagcaattggagaagaggatgaagttaatggtaacctgttggagactgatgttgatgggcaagttggaaccactcaggagaatctgaatcagcaatatcagaaagttaaggcccaacacgagaagatcatctctcagcaccaagcagtgatcatagccactcagtctgcacaagtgttgcttgagaaacagggtcagtatctctctcctgaagaaaaagagaaactgcaaaagaacatgaaggaactgaaagtgcattatgaaactgcactggctgagtcagagaagaaaatgaagttaactcactctctgcaggaagaattagaaaagtttgatgctgactataccgagtttgagcactggctacagcagtcagaacaagaacttgaaaacctggaggcaggtgcagatgacatcaatggtttaatgaccaaattgaagaggcagaagagtttctcagaagacgttatttctcacaaaggtgacttgagatacatcacaatttctggaaacagagtgttggaagctgccaaatcttgcagcaagagagacggtggcaaggttgatacttctgcaacccacagagaagtgcagcgcaagttggatcatgctactgatcggttcaggtctctctactctaagtgcaatgttcttggaaataatcttaaagatctggtggataaatatcaacactatgaagatgcttcatgtggacttcttgctggactccaggcctgtgaggccacagcgagcaaacacttatctgaacctattgcggtggaccccaaaaatcttcaaaggcaattagaagagaccaaggctttgcaaggacagatatcaagtcagcaggttgctgtagagaaactgaagaaaacggctgaagtgcttttagatgccaggggatctttacttccagccaagaatgatatccagaaaacacttgatgacattgttgggagatatgaggatctgtccaagtctgttaatgaacgaaatgaaaaactccagataaccttgacccgttcactgagtgtgcaggatggcttggatgaaatgctggactggatgggaaatgtggaaagttctctgaaagaacaaggtcaagtgcctttaaactctactgctcttcaggatattatcagtaaaaacattatgttggaacaggatattgcaggtcgtcagagcagtataaatgccatgaatgaaaaagtgaagaaatttatggaaacaacagatccatccactgcatcctcactgcaagccaaaatgaaagacttgtctgctcggttttcagaagcaagtcataaacacaaagaaactcttgccaaaatggaggagctaaaaaccaaagtagaactgtttgagaacctctcagaaaagctccagacatttttagaaacaaaaactcaggctcttactgaagtagatgtgccaggaaaagatgttactgaattgtctcagtatatgcaggaatcaacttctgaatttttagaacacaagaaacatcttgaagttttgcatagtctcttgaaggagatatccagccatggcttaccaagtgataaggctttggtccttgaaaaaacaaataatttgtcaaagaaattcaaggaaatggaggataccatcaaagaaaaaaaagaagctgtaacttcttgtcaagaacagttggatgctttccaagttcttgttaaatcattgaagtcatggataaaagaaacaacaaaaaaagttcccattgtacagccttcttttggtgcagaggatttaggaaaatctttggaagacactaagaaattacaagaaaagtggagtttaaaaacaccagagattcagaaagtaaacaacagtgggatctcactatgtaacttaataagtgctgtgaccacccctgcaaaggcaatagcagcagttaaatcaggtggagcagtattaaatggtgaaggaacagccacaaatactgaggaattttgggcaaataaaggtttaacatccattaaaaaggacatgactgacataagtcatggttatgaagatcttggcctcttactcaaggacaaaatagcggaactgaacactaaactctccaaattgcaaaaggctcaggaagaatcaagtgcaatgatgcagtggttacagaaaatgaacaaaactgcaacaaaatggcagcagacacctgcacctacagatactgaagctgtgaagactcaagttgagcagaataagtcgtttgaggcagaactgaagcagaatgtaaacaaagtacaggagttgaaagacaaattgacagagctgttggaggagaacccagatactcctgaggcccccagatggaaacagatgttgacagaaatagattctaagtggcaagaactcaatcaattaacaattgatagacaacaaaaactggaagaatcctccaataatctaacccagttccagactgtagaggcccaattgaaacagtggcttgtggaaaaagaacttatggtcagtgttcttgggcccttgtcaattgacccaaatatgctaaacacacaaaggcagcaggtgcagattttgctgcaagaattcgccactcggaaacctcaatatgaacagctgacagcagctggtcagggcattctgagcaggcctggagaagacccttctttacgtgggattgtgaaagagcaactggcagctgtgacccaaaaatgggatagcctaacagggcaattgagtgacagatgtgactggattgaccaagccattgttaaaagcacacagtatcaaagcctgctgagaagcctttctgataaactgagtgacttggataataaactcagcagcagtctggctgtgagcacgcaccctgatgctatgaaccaacagttggaaacagcccaaaaaatgaagcaggagatacagcaggaaaagaagcagataaaagtggcccaggcactctgtgaggatttgtcagcactggttaaagaagagtacttgaaagcagaacttagtaggcaactagaaggcatcttaaaatcatttaaggatgttgaacagaaagcagagaatcatgtccagcaccttcagtcggcctgtgcaagctctcatcaatttcagcaaatgtctagagattttcaggcttggctggatacaaagaaagaagagcaaaacaaatctcatccaatatctgccaaactcgatgtcttggagtcattaattaaagatcataaagactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagcaggtgaaagaaagagaaaacaagttaaaagagtcattggaaaaagcccttaagtataaagagcaagtagagactctctggccatggatagacaaatgccaaaacaacctggaggaaataaaattttgcttggatcctgctgaaggagagaattctattgccaagttaaagtctctgcagaaggaaatggaccaacactttggtatggtagaattactgaacaacacagccaatagcttgctcagtgtctgtgagatagataaagaagttgttacagatgagaataagtcactgatccagaaggtggacatggtcactgaacaacttcacagtaagaaattctgtctggagaacatgactcagaagtttaaagaatttcaagaagtttccaaagaatctaaaaggcagcttcagtgtgcaaaggagcagctagatatccatgattcgctgggatcccaggcttacagtaacaaatacctgaccatgttgcaaactcagcagaaatcacttcaggccttgaagcatcaggtagatttggctaaaagacttgcacaggaccttgtggtagaggcctcagactcaaagggaacctctgatgttttattacaagtggaaaccatagctcaagagcatagtacactaagtcagcaggttgatgaaaagtgttctttcttagaaaccaagcttcagggcattgggcatttccagaataccattcgagaaatgttttctcagttcgcagagtttgatgatgaactggatagcatggctccagtggggagagatgcagaaacattgcaaaagcaaaaggaaactataaaagcctttctaaagaaactagaagccctcatggcaagcaatgacaatgccaataaaacctgcaagatgatgttagccacagaagaaacctctcctgaccttgttggaatcaaaagggacttggaggccttaagcaaacaatgcaacaagttactggaccgagcccaagccagagaagagcaggttgaagggacaattaagcgccttgaagaattttacagcaaattgaaagaattttctattctgctccagaaagccgaagaacatgaagagtcacaaggtcctgttggtatggaaacggagacaattaatcagcagcttaacatgttcaaggtattccagaaagaagagattgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagccttagaagatgacatcatcaatcacaataaacatttacaccaggctgttagcattggccagtccttaaaggttttgagctccagggaggataaagatatggtgcagagtaaattagacttctctcaagtatggtacattgagattcaagagaaaagtcacagcaggtctgagctcctccagcaggccttatgtaatgctaagatttttggggaagatgaagttgaactgatgaactggctgaatgaagtgcatgacaaactgagcaagctctcagtccaggattacagcactgaggggctatggaagcagcagtctgaacttcgggttctgcaagaggacatcttactcaggaaacaaaatgtagatcaggctttactaaatggtttagaactacttaaacaaaccacaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcagtttgaccaagcagctgatgctgagttatcctggattactgaaacagaaaaaaaattgatgtctctgggtgacatcaggcttgagcaagaccagacttctgctcagcttcaagttcaaaagacattcaccatggagattttgagacacaaggatattattgatgaccttgttaaatctgggcataaaatcatgaccgcatgcagtgaagaggaaaagcaatcaatgaagaaaaaactggacaaggtactgaagaactatgataccatctgccagattaattcagaaaggtatctgcagctggaacgggcacagtccctggttaaccaattctgggaaacatatgaagaactttggccatggctgacagaaacacaatcaatcatctctcagcttcccgccccagcccttgaatatgaaactctaaggcagcagcaggaagaacatcggcaactgcgtgagttgatagctgaacacaagcctcatatagataagatgaacaaaactgggccacagttactggaattgagccctggggaaggcttttctatccaagagaagtatgtggcagccgacaccctttacagtcaaattaaagaagatgtcaaaaagcgtgctgtggcactggatgaagccatttctcaatcaactcagttccatgacaagatagatcagatccttgagagcctggaacgcatcgtggaacgtctgaggcagccaccctctatctctgcagaggttgagaagatcaaggaacagatcagtgaaaataagaatgtgtcagtagacatggaaaagctacagccgttgtatgaaactcttaaacagaggggagaggaaatgattgctagatctggggggactgataaagacatatctgccaaagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagagaccataagggaagaaatagatggactacaggaggagctggatatagttattaacctaggttctgaactcattgcggcatgtggggagcctgataaacccattgtcaagaagagtatagatgagttaaattcagcatgggattctctaaataaagcttggaaagaccggattgacaaacttgaggaggcaatgcaggctgccgttcagtaccaggatggactgcaggcggtatttgactgggtagatattgcaggtggtaaattagcttcaatgtctccaattggaacagatctcgaaactgtcaagcagcagattgaagagctaaagcaatttaagtctgaggcctatcaacagcagatagaaatggaaagactgaatcatcaagcagagcttttgctaaagaaagtaacagaagagagtgacaaacacactgttcaagacccattaatggaactgaaattgatatgggatagcctggaggagagaatcatcaacagacagcataaactggagggtgctctattagccttgggtcagttccaacatgccctggatgagctcctggcatggctgacacacaccgagggcttgctaagtgagcagaaacctgttggaggagaccctaaagccattgaaattgaacttgccaagcatcatgtgctccaaaatgatgtattagcccatcagtccacagtggaagccgttaataaagcaggaaatgatctaattgaatcaagtgcaggagaagaagcaagcaaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactgctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacagggtaagttttcaaagtaattttggagactcccagcaactgcgactggtccggatcctgcggagtactgtgatggttcgtgttggaggtggatggatggcacttgatgagttcttagtgaaaaatgatccttgcagggttcatcatcatgggagtaaaatgttacgttcggaatcaaactcttcaattactactactcagcctactatagccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatgg

SEQ ID NO: 9072 - DNA, 9180 bp, Homo sapiens
atgcacagtagtagttatagttaccgtagcagtgattctgtgtttagtaacactaccagcactcgaaccagtcttgattcaaatgaaaatcttctcttggttcattgtggtccaacactgatcaactcttgcattagcttcggcagtgaatcctttgatggacacaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagaagtcactggaagaagaaaagaaagaacatgttgaaaaagccaaagaattgcaaaaatgggtatcaaatatcagcaagacattgaaagatgcagagaaggctggaaaacctcccttctctaagcaaaagatttccagtgaggaaatatcaaccaagaaggaacaattatcggaagcacttcaaactatacagctttttttggcaaaacatggagacaaaatgacagatgaagaaagaaatgaattggaaaaacaagtgaaaactcttcaggaaagttataatttattattcagtgaatctctgaaacagctacaagaatcacaaacctcaggagatgtaaaggtagaggagaagctggataaagtgattgcaggcaccattgatcagacaactggagaagtcctttcagtctttcaagcagttttaagaggcctcattgactatgacacaggaattaggttgcttgagacacagctaatgatttctggtctaatttcaccagaattaagaaagtgctttgaccttaaagatgccaaaagtcatggccttattgatgaacaaattctgtgccaactcaaagaactaagtaaagctaaggagattatttctgctgcgtcacctaccacaattccagtactggatgctctagctcaaagcatgataacagaatccatggccatcaaagttcttgagatactgctttctacaggctctctggttattccagccacaggagaacagttgaccctacagaaggctttccaacagaacttggtttcctcagcattattttctaaagttctggaaaggcaaaatatgtgcaaagatcttattgacccctgcacctctgagaaggtttctttaatagatatggtacaaagaagtactttacaggaaaacacagggatgtggcttctacctgtgagaccacaagaaggaggtagaataacattaaaatgtggaagaaacataagcattttaagagcagctcatgaaggtctcatagaccgtgaaaccatgtttaggttgttaagtgcacagcttctttctggaggtctgatcaattccaactctggccaaagaatgactgttgaagaagctgtcagagaaggggtgattgacagggacactgctagcagtatcctcacatatcaggttcaaactggtggaatcatccagtcaaaccctgccaagcgtttaactgtagacgaagcagtacagtgtgatttaataacttccagcagtgctcttctggtcctggaagctcagcgaggctatgttggactcatttggccccattctggtgaaatatttcccacatcatcttccttgcagcaagaattgattacaaatgaattggcctacaaaatcctgaatggcagacaaaaaatagctgctctttatattccagaaagttctcaagtcattggtttggatgctgctaaacagctaggaattatagacaacaacacagcatcaattttaaaaaatataacactgcctgataaaatgccagatttaggagatttagaagcttgtaaaaatgccagaagatggctctctttttgtaaatttcaaccctccacagttcatgattacagacaagaagaggatgtttttgatggagaagaacctgtcactactcagacctcagaagaaactaaaaaattatttctatcttatttaatgataaatagctatatggatgcaaacacagggcaaaggcttttgctgtacgatggagacttggatgaggctgttggcatgctactggaaggctgtcatgcagaatttgatggaaacacagccataaaagaatgtctcgatgtcttaagctcatctggtgtatttcttaataatgcttcaggtagagaaaaggatgaatgtacagctacaccaagtagtttcaataaatgtcactgtggagaacctgaacatgaagagactcctgaaaatagaaagtgtgctatagatgaagaatttaatgaaatgagaaatactgttatcaatagtgaattttctcagtcaggaaaactggcaagtacaatatcaattgatcctaaagttaacagttcacccagtgtgtgtgttcccagtctcatatcatatttaacacagactgaacttgcagacattagcatgcttagaagtgactctgaaaacatacttacaaactatgaaaatcaaagccgagtggaaacaaatgaacgtgcaaatgaatgtagtcattctaaaaacattcaaaactttccaagtgatttaatagaaaatcctattatgaaatcaaaaatgagtaaattctgtggtgtgaatgaaacagagaatgaagataatacaaacagggattcacctatctttgactattcccccaggctaagtgccttgttaagtcatgataaattgatgcacagtcagggaagttttaatgatacacacaccccagagagcaatggaaataagtgtgaagccccagccttatcattcagtgacaaaaccatgttgtcaggtcaaagaataggagaaaaatttcaagaccagtttctgggaattgcagctattaacatcagtttaccaggagagcagtatggacagaaatctttaaatatgatttctagtaatcctcaagtacaatatcacaatgataaatacatttcaaatacttctggtgaggatgaaaaaacacatccaggttttcagcagatgcctgaagacaaggaagatgagtctgaaatagaagagtattcctgtgctgtgactccagggggtgatactgataatgccattgtgtctcttacttgtgctacaccattgcttgatgaaaccatcagtgctagtgactatgaaacgtcactgctgaatgatcagcagaataacacaggaacagacactgatagtgatgatgatttttatgatactcccttgtttgaagatgatgaccatgattctttgcttcttgatggtgatgatcgtgattgcctgcaccctgaggactacgacacactgcaagaggaaaatgatgagacggcttctcctgctgatgttttttatgatgtctcaaaagagaatgaaaattccatggttccccagggggcaccagttggtagcttaagtgtgaagaacaaagcacattgtcttcaggatttccttatggatgttgagaaagatgaattagattctggtgaaaaaatacatttaaatcctgttggctcagataaggtgaatggacagtcactggaaactggatcagaaagggaatgcacaaatatccttgaaggtgatgaatctgactcattgactgattatgatattgtaggaggaaaagagagcttcactgcatcattaaaatttgatgacagtggcagttggagaggaagaaaggaagagtatgtaactggacaggaatttcactccgatactgatcatttagattctatgcaaagtgaagaaagttatggggattatatatatgacagtaatgatcaggatgacgatgatgatgatggcattgatgaagaaggaggaggtataagagatgagaatggaaagcccaggtgccaaaatgtggctgaagatatggatatccagttgtgtgcctctattttaaatgaaaacagtgatgaaaatgaaaatattaatacaatgattcttctggataaaatgcacagttgtagctctttagaaaaacagcaaagggtaaatgttgtacagctagcatcacctagtgaaaataacttagttactgaaaaaagcaaccttccagaatatacaactgagattgctggaaaaagcaaagaaaatctgttgaaccatgagatggtacttaaggatgtattgccgcctatcattaaagacactgaatctgaaaaaacttttggccctgcaagtatttcacatgataataataatatcagttcaacttctgaattaggtactgatctagcaaacacaaaggttaagttgattcaagggtcagaattgccagaattgactgattctgtgaaaggtaaagatgaatattttaagaatatgacaccaaaagttgactcatctcttgatcacatcatttgtactgagcctgatttaataggaaaacctgctgaggaaagccatttgtcattgatagcctctgtaactgacaaagatcctcaaggaaatggaagcgatctcattaaagggagagatggcaaaagtgatattctaatagaagatgaaacatcaattcagaaaatgtacttgggtgaaggagaagtgcttgtagaaggtctagtagaagaagaaaataggcatctcaaacttttgcctggtaaaaatacaagggatagtttcaagttaattaatagtcagtttccatttccacaaatcacaaacaatgaagaacttaatcagaaaggaagccttaaaaaagcaactgtaactcttaaagatgaaccaaataatctacaaataatagttagtaaaagtcctgttcagtttgagaatcttgaagaaatttttgacacatcagtttccaaagagattagtgatgacattacttcagacattacatcgtgggaagggaatacacattttgaggagtcattcactgatggacctgagaaagagcttgatctgtttacttacttaaaacattgtgctaaaaatataaaagcaaaagatgtagccaaaccaaatgaagatgtcccaagccatgttttaataactgcccctcccatgaaagaacatttacaattaggagttaataatacaaaagagaagtccactagtacccaaaaagactcacctcttaatgacatgatccaaagcaatgatctttgtagtaaagaaagcatctcaggaggaggaacagaaatttctcagttcacaccagaaagtattgaagccacactttcaatattatctcgtaaacatgtagaagatgttgggaaaaatgattttctgcagtcggagcggtgtgcaaatggattaggaaatgataactccagtaacactttaaatactgactattcattcttagaaattaataataagaaagaaagaattgagcaacagctaccaaaagaacaagccttgtctccaagatcccaagaaaaggaggttcagattcctgaattgtctcaggtatttgtggaggatgtaaaggatatcttaaaaagcaggttgaaagaaggtcatatgaaccctcaagaggttgaagaaccttcagcctgtgcagacactaaaattttaattcaaaatttaattaaaaggattaccacatcacagttggtaaatgaggcatctactgtgcccagcgactctcaaatgagtgactcttctggagtttcccccatgactaactcatcagaactaaagccagaaagtagagatgatcctttctgtattggaaatcttaagtctgagcttctccttaatatattgaagcaagatcaacatagccaaaaaattacaggagtatttgaattgatgagagaattaactcatatggagtatgacctagagaaaagaggcattacgtctaaagtacttccactgcagcttgaaaatattttctacaaactgcttgctgatggatattcagagaaaatagaacatgttggagactttaatcaaaaagcatgttctacatctgagatgatggaagaaaagccacatattcttggtgatattaaaagcaaagaaggaaactactattctcctaatttagaaactgtaaaagaaattggactagaaagctctactgtgtgggcatcaacattgccaagagatgagaagctcaaggatctgtgtaatgatttcccaagccatttggaatgtacttcagggtctaaagagatggcttctggagatagctcaaccgaacaa

SEQ ID NO: 9073 - DNA, 22865 bp, Homo sapiens
aatattcagctgccacttttcaccgttagaagtagagctttttccagacctcctaccttttagtctactttgaaaggtgaaagaaagaacatcgtttcaggaataaaaatgcacagtagtagttatagttaccgtagcagtgattctgtgtttagtaacactaccagcactcgaaccagtcttgattcaaatgaaaatcttctcttggttcattgtggtccaacactgatcaactcttgcattagcttcggcagtgaatcctttgatggacacaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagaagtcactggaagaagaaaagaaagaacatgttgaaaaagccaaagaattgcaaaaatgggtatcaaatatcagcaagacattgaaagatgcagagaaggctggaaaacctcccttctctaagcaaaagatttccagtgaggaaatatcaaccaagaaggaacaattatcggaagcacttcaaactatacagctttttttggcaaaacatggagacaaaatgacagatgaagaaagaaatgaattggaaaaacaagtgaaaactcttcaggaaagttataatttattattcagtgaatctctgaaacagctacaagaatcacaaacctcaggagatgtaaaggtagaggagaagctggataaagtgattgcaggcaccattgatcagacaactggagaagtcctttcagtctttcaagcagttttaagaggcctcattgactatgacacaggaattaggttgcttgagacacagctaatgatttctggtctaatttcaccagaattaagaaagtgctttgaccttaaagatgccaaaagtcatggccttattgatgaacaaattctgtgccaactcaaagaactaagtaaagctaaggagattatttctgctgcgtcacctaccacaattccagtactggatgctctagctcaaagcatgataacagaatccatggccatcaaagttcttgagatactgctttctacaggctctctggttattccagccacaggagaacagttgaccctacagaaggctttccaacagaacttggtttcctcagcattattttctaaagttctggaaaggcaaaatatgtgcaaagatcttattgacccctgcacctctgagaaggtttctttaatagatatggtacaaagaagtactttacaggaaaacacagggatgtggcttctacctgtgagaccacaagaaggaggtagaataacattaaaatgtggaagaaacataagcattttaagagcagctcatgaaggtctcatagaccgtgaaaccatgtttaggttgttaagtgcacagcttctttctggaggtctgatcaattccaactctggccaaagaatgactgttgaagaagctgtcagagaaggggtgattgacagggacactgctagcagtatcctcacatatcaggttcaaactggtggaatcatccagtcaaaccctgccaagcgtttaactgtagacgaagcagtacagtgtgatttaataacttccagcagtgctcttctggtcctggaagctcagcgaggctatgttggactcatttggccccattctggtgaaatatttcccacatcatcttccttgcagcaagaattgattacaaatgaattggcctacaaaatcctgaatggcagacaaaaaatagctgctctttatattccagaaagttctcaagtcattggtttggatgctgctaaacagctaggaattatagacaacaacacagcatcaattttaaaaaatataacactgcctgataaaatgccagatttaggagatttagaagcttgtaaaaatgccagaagatggctctctttttgtaaatttcaaccctccacagttcatgattacagacaagaagaggatgtttttgatggagaagaacctgtcactactcagacctcagaagaaactaaaaaattatttctatcttatttaatgataaatagctatatggatgcaaacacagggcaaaggcttttgctgtacgatggagacttggatgaggctgttggcatgctactggaaggctgtcatgcagaatttgatggaaacacagccataaaagaatgtctcgatgtcttaagctcatctggtgtatttcttaataatgcttcaggtagagaaaaggatgaatgtacagctacaccaagtagtttcaataaatgtcactgtggagaacctgaacatgaagagactcctgaaaatagaaagtgtgctatagatgaagaatttaatgaaatgagaaatactgttatcaatagtgaattttctcagtcaggaaaactggcaagtacaatatcaattgatcctaaagttaacagttcacccagtgtgtgtgttcccagtctcatatcatatttaacacagactgaacttgcagacattagcatgcttagaagtgactctgaaaacatacttacaaactatgaaaatcaaagccgagtggaaacaaatgaacgtgcaaatgaatgtagtcattctaaaaacattcaaaactttccaagtgatttaatagaaaatcctattatgaaatcaaaaatgagtaaattctgtggtgtgaatgaaacagagaatgaagataatacaaacagggattcacctatctttgactattcccccaggctaagtgccttgttaagtcatgataaattgatgcacagtcagggaagttttaatgatacacacaccccagagagcaatggaaataagtgtgaagccccagccttatcattcagtgacaaaaccatgttgtcaggtcaaagaataggagaaaaatttcaagaccagtttctgggaattgcagctattaacatcagtttaccaggagagcagtatggacagaaatctttaaatatgatttctagtaatcctcaagtacaatatcacaatgataaatacatttcaaatacttctggtgaggatgaaaaaacacatccaggttttcagcagatgcctgaagacaaggaagatgagtctgaaatagaagagtattcctgtgctgtgactccagggggtgatactgataatgccattgtgtctcttacttgtgctacaccattgcttgatgaaaccatcagtgctagtgactatgaaacgtcactgctgaatgatcagcagaataacacaggaacagacactgatagtgatgatgatttttatgatactcccttgtttgaagatgatgaccatgattctttgcttcttgatggtgatgatcgtgattgcctgcaccctgaggactacgacacactgcaagaggaaaatgatgagacggcttctcctgctgatgttttttatgatgtctcaaaagagaatgaaaattccatggttccccagggggcaccagttggtagcttaagtgtgaagaacaaagcacattgtcttcaggatttccttatggatgttgagaaagatgaattagattctggtgaaaaaatacatttaaatcctgttggctcagataaggtgaatggacagtcactggaaactggatcagaaagggaatgcacaaatatccttgaaggtgatgaatctgactcattgactgattatgatattgtaggaggaaaagagagcttcactgcatcattaaaatttgatgacagtggcagttggagaggaagaaaggaagagtatgtaactggacaggaatttcactccgatactgatcatttagattctatgcaaagtgaagaaagttatggggattatatatatgacagtaatgatcaggatgacgatgatgatgatggcattgatgaagaaggaggaggtataagagatgagaatggaaagcccaggtgccaaaatgtggctgaagatatggatatccagttgtgtgcctctattttaaatgaaaacagtgatgaaaatgaaaatattaatacaatgattcttctggataaaatgcacagttgtagctctttagaaaaacagcaaagggtaaatgttgtacagctagcatcacctagtgaaaataacttagttactgaaaaaagcaaccttccagaatatacaactgagattgctggaaaaagcaaagaaaatctgttgaaccatgagatggtacttaaggatgtattgccgcctatcattaaagacactgaatctgaaaaaacttttggccctgcaagtatttcacatgataataataatatcagttcaacttctgaattaggtactgatctagcaaacacaaaggttaagttgattcaagggtcagaattgccagaattgactgattctgtgaaaggtaaagatgaatattttaagaatatgacaccaaaagttgactcatctcttgatcacatcatttgtactgagcctgatttaataggaaaacctgctgaggaaagccatttgtcattgatagcctctgtaactgacaaagatcctcaaggaaatggaagcgatctcattaaagggagagatggcaaaagtgatattctaatagaagatgaaacatcaattcagaaaatgtacttgggtgaaggagaagtgcttgtagaaggtctagtagaagaagaaaataggcatctcaaacttttgcctggtaaaaatacaagggatagtttcaagttaattaatagtcagtttccatttccacaaatcacaaacaatgaagaacttaatcagaaaggaagccttaaaaaagcaactgtaactcttaaagatgaaccaaataatctacaaataatagttagtaaaagtcctgttcagtttgagaatcttgaagaaatttttgacacatcagtttccaaagagattagtgatgacattacttcagacattacatcgtgggaagggaatacacattttgaggagtcattcactgatggacctgagaaagagcttgatctgtttacttacttaaaacattgtgctaaaaatataaaagcaaaagatgtagccaaaccaaatgaagatgtcccaagccatgttttaataactgcccctcccatgaaagaacatttacaattaggagttaataatacaaaagagaagtccactagtacccaaaaagactcacctcttaatgacatgatccaaagcaatgatctttgtagtaaagaaagcatctcaggaggaggaacagaaatttctcagttcacaccagaaagtattgaagccacactttcaatattatctcgtaaacatgtagaagatgttgggaaaaatgattttctgcagtcggagcggtgtgcaaatggattaggaaatgataactccagtaacactttaaatactgactattcattcttagaaattaataataagaaagaaagaattgagcaacagctaccaaaagaacaagccttgtctccaagatcccaagaaaaggaggttcagattcctgaattgtctcaggtatttgtggaggatgtaaaggatatcttaaaaagcaggttgaaagaaggtcatatgaaccctcaagaggttgaagaaccttcagcctgtgcagacactaaaattttaattcaaaatttaattaaaaggattaccacatcacagttggtaaatgaggcatctactgtgcccagcgactctcaaatgagtgactcttctggagtttcccccatgactaactcatcagaactaaagccagaaagtagagatgatcctttctgtattggaaatcttaagtctgagcttctccttaatatattgaagcaagatcaacatagccaaaaaattacaggagtatttgaattgatgagagaattaactcatatggagtatgacctagagaaaagaggcattacgtctaaagtacttccactgcagcttgaaaatattttctacaaactgcttgctgatggatattcagagaaaatagaacatgttggagactttaatcaaaaagcatgttctacatctgagatgatggaagaaaagccacatattcttggtgatattaaaagcaaagaaggaaactactattctcctaatttagaaactgtaaaagaaattggactagaaagctctactgtgtgggcatcaacattgccaagagatgagaagctcaaggatctgtgtaatgatttcccaagccatttggaatgtacttcagggtctaaagagatggcttctggagatagctcaaccgaacaattttccagtgaattacagcagtgtttacagcacactgaaaaaatgcatgagtatttgacattgcttcaagatatgaaaccccccttagacaaccaggaatctctggataacaacttggaagctttgaagaatcaacttagacagttggagacatttgaattgggattagctccaattgctgttattttaagaaaagatatgaagttggcagaagagtttttaaagtctcttcccagtgactttcccagaggccatgttgaagaattgagtattagccaccagagtttgaagaccgccttctcttccctcagcaacgtgtcttcagaaagaacgaaacagatcatgcttgcgatcgactctgaaatgtctaaactagcagtttcccatgaagaatttctgcataaacttaagtcattctcagattgggtatcagagaagagcaaatctgtgaaggatattgagattgtgaatgttcaagattctgagtatgtaaagaaacgtttggagtttctcaaggcaaataatgtattaaaagaccttggacataccaaaatgcagctggagactactgcctttgatgtgcagttcttcatttctgaatatgcacaggatctgtctcccaaccaaagcaaacaactgctgaggctcttaaatacaactcagaagtgttttcttgatgtacaggagtcagtaactacccaggtggaacgtttagagactcagttacatctagaacaagatcttgatgatcagaagattgtagcagagcgtcagcaggagtataaagagaaactccaagggatatgtgatcttcttacccaaactgaaaaccgcctaattggtcaccaagaagccttcatgattggagatggcacagttgagttaaagaaatatcagtccaagcaagaggaattacagaaagatatgcaaggaagtgcacaggcattggctgaagtagtgaaaaacacagagaacttcttaaaagagaatggtgaaaagctgtcacaggaagataaggctttgattgaacagaaacttaatgaagctaagataaagtgtgaacagcttaatttaaaagcagaacagtctaaaaaggagctggataaagttgtgacaacagcaatcaaggaagaaactgaaaaggtagcagcagtgaagcagctggaagagagcaaaaccaaaatagaaaaccttttggactggttgtcaaatgttgacaaagactcagaaagggcagggacaaaacacaaacaggtaatcgaacagaacgggacccattttcaagaaggtgatggcaagtcagcaattggagaagaggatgaagttaatggtaacctgttggagactgatgttgatgggcaagttggaaccactcaggagaatctgaatcagcaatatcagaaagttaaggcccaacacgagaagatcatctctcagcaccaagcagtgatcatagccactcagtctgcacaagtgttgcttgagaaacagggtcagtatctctctcctgaagaaaaagagaaactgcaaaagaacatgaaggaactgaaagtgcattatgaaactgcactggctgagtcagagaagaaaatgaagttaactcactctctgcaggaagaattagaaaagtttgatgctgactataccgagtttgagcactggctacagcagtcagaacaagaacttgaaaacctggaggcaggtgcagatgacatcaatggtttaatgaccaaattgaagaggcagaagagtttctcagaagacgttatttctcacaaaggtgacttgagatacatcacaatttctggaaacagagtgttggaagctgccaaatcttgcagcaagagagacggtggcaaggttgatacttctgcaacccacagagaagtgcagcgcaagttggatcatgctactgatcggttcaggtctctctactctaagtgcaatgttcttggaaataatcttaaagatctggtggataaatatcaacactatgaagatgcttcatgtggacttcttgctggactccaggcctgtgaggccacagcgagcaaacacttatctgaacctattgcggtggaccccaaaaatcttcaaaggcaattagaagagaccaaggctttgcaaggacagatatcaagtcagcaggttgctgtagagaaactgaagaaaacggctgaagtgcttttagatgccaggggatctttacttccagccaagaatgatatccagaaaacacttgatgacattgttgggagatatgaggatctgtccaagtctgttaatgaacgaaatgaaaaactccagataaccttgacccgttcactgagtgtgcaggatggcttggatgaaatgctggactggatgggaaatgtggaaagttctctgaaagaacaaggtcaagtgcctttaaactctactgctcttcaggatattatcagtaaaaacattatgttggaacaggatattgcaggtcgtcagagcagtataaatgccatgaatgaaaaagtgaagaaatttatggaaacaacagatccatccactgcatcctcactgcaagccaaaatgaaagacttgtctgctcggttttcagaagcaagtcataaacacaaagaaactcttgccaaaatggaggagctaaaaaccaaagtagaactgtttgagaacctctcagaaaagctccagacatttttagaaacaaaaactcaggctcttactgaagtagatgtgccaggaaaagatgttactgaattgtctcagtatatgcaggaatcaacttctgaatttttagaacacaagaaacatcttgaagttttgcatagtctcttgaaggagatatccagccatggcttaccaagtgataaggctttggtccttgaaaaaacaaataatttgtcaaagaaattcaaggaaatggaggataccatcaaagaaaaaaaagaagctgtaacttcttgtcaagaacagttggatgctttccaagttcttgttaaatcattgaagtcatggataaaagaaacaacaaaaaaagttcccattgtacagccttcttttggtgcagaggatttaggaaaatctttggaagacactaagaaattacaagaaaagtggagtttaaaaacaccagagattcagaaagtaaacaacagtgggatctcactatgtaacttaataagtgctgtgaccacccctgcaaaggcaatagcagcagttaaatcaggtggagcagtattaaatggtgaaggaacagccacaaatactgaggaattttgggcaaataaaggtttaacatccattaaaaaggacatgactgacataagtcatggttatgaagatcttggcctcttactcaaggacaaaatagcggaactgaacactaaactctccaaattgcaaaaggctcaggaagaatcaagtgcaatgatgcagtggttacagaaaatgaacaaaactgcaacaaaatggcagcagacacctgcacctacagatactgaagctgtgaagactcaagttgagcagaataagtcgtttgaggcagaactgaagcagaatgtaaacaaagtacaggagttgaaagacaaattgacagagctgttggaggagaacccagatactcctgaggcccccagatggaaacagatgttgacagaaatagattctaagtggcaagaactcaatcaattaacaattgatagacaacaaaaactggaagaatcctccaataatctaacccagttccagactgtagaggcccaattgaaacagtggcttgtggaaaaagaacttatggtcagtgttcttgggcccttgtcaattgacccaaatatgctaaacacacaaaggcagcaggtgcagattttgctgcaagaattcgccactcggaaacctcaatatgaacagctgacagcagctggtcagggcattctgagcaggcctggagaagacccttctttacgtgggattgtgaaagagcaactggcagctgtgacccaaaaatgggatagcctaacagggcaattgagtgacagatgtgactggattgaccaagccattgttaaaagcacacagtatcaaagcctgctgagaagcctttctgataaactgagtgacttggataataaactcagcagcagtctggctgtgagcacgcaccctgatgctatgaaccaacagttggaaacagcccaaaaaatgaagcaggagatacagcaggaaaagaagcagataaaagtggcccaggcactctgtgaggatttgtcagcactggttaaagaagagtacttgaaagcagaacttagtaggcaactagaaggcatcttaaaatcatttaaggatgttgaacagaaagcagagaatcatgtccagcaccttcagtcggcctgtgcaagctctcatcaatttcagcaaatgtctagagattttcaggcttggctggatacaaagaaagaagagcaaaacaaatctcatccaatatctgccaaactcgatgtcttggagtcattaattaaagatcataaagactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagcaggtgaaagaaagagaaaacaagttaaaagagtcattggaaaaagcccttaagtataaagagcaagtagagactctctggccatggatagacaaatgccaaaacaacctggaggaaataaaattttgcttggatcctgctgaaggagagaattctattgccaagttaaagtctctgcagaaggaaatggaccaacactttggtatggtagaattactgaacaacacagccaatagcttgctcagtgtctgtgagatagataaagaagttgttacagatgagaataagtcactgatccagaaggtggacatggtcactgaacaacttcacagtaagaaattctgtctggagaacatgactcagaagtttaaagaatttcaagaagtttccaaagaatctaaaaggcagcttcagtgtgcaaaggagcagctagatatccatgattcgctgggatcccaggcttacagtaacaaatacctgaccatgttgcaaactcagcagaaatcacttcaggccttgaagcatcaggtagatttggctaaaagacttgcacaggaccttgtggtagaggcctcagactcaaagggaacctctgatgttttattacaagtggaaaccatagctcaagagcatagtacactaagtcagcaggttgatgaaaagtgttctttcttagaaaccaagcttcagggcattgggcatttccagaataccattcgagaaatgttttctcagttcgcagagtttgatgatgaactggatagcatggctccagtggggagagatgcagaaacattgcaaaagcaaaaggaaactataaaagcctttctaaagaaactagaagccctcatggcaagcaatgacaatgccaataaaacctgcaagatgatgttagccacagaagaaacctctcctgaccttgttggaatcaaaagggacttggaggccttaagcaaacaatgcaacaagttactggaccgagcccaagccagagaagagcaggttgaagggacaattaagcgccttgaagaattttacagcaaattgaaagaattttctattctgctccagaaagccgaagaacatgaagagtcacaaggtcctgttggtatggaaacggagacaattaatcagcagcttaacatgttcaaggtattccagaaagaagagattgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagccttagaagatgacatcatcaatcacaataaacatttacaccaggctgttagcattggccagtccttaaaggttttgagctccagggaggataaagatatggtgcagagtaaattagacttctctcaagtatggtacattgagattcaagagaaaagtcacagcaggtctgagctcctccagcaggccttatgtaatgctaagatttttggggaagatgaagttgaactgatgaactggctgaatgaagtgcatgacaaactgagcaagctctcagtccaggattacagcactgaggggctatggaagcagcagtctgaacttcgggttctgcaagaggacatcttactcaggaaacaaaatgtagatcaggctttactaaatggtttagaactacttaaacaaaccacaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcagtttgaccaagcagctgatgctgagttatcctggattactgaaacagaaaaaaaattgatgtctctgggtgacatcaggcttgagcaagaccagacttctgctcagcttcaagttcaaaagacattcaccatggagattttgagacacaaggatattattgatgaccttgttaaatctgggcataaaatcatgaccgcatgcagtgaagaggaaaagcaatcaatgaagaaaaaactggacaaggtactgaagaactatgataccatctgccagattaattcagaaaggtatctgcagctggaacgggcacagtccctggttaaccaattctgggaaacatatgaagaactttggccatggctgacagaaacacaatcaatcatctctcagcttcccgccccagcccttgaatatgaaactctaaggcagcagcaggaagaacatcggcaactgcgtgagttgatagctgaacacaagcctcatatagataagatgaacaaaactgggccacagttactggaattgagccctggggaaggcttttctatccaagagaagtatgtggcagccgacaccctttacagtcaaattaaagaagatgtcaaaaagcgtgctgtggcactggatgaagccatttctcaatcaactcagttccatgacaagatagatcagatccttgagagcctggaacgcatcgtggaacgtctgaggcagccaccctctatctctgcagaggttgagaagatcaaggaacagatcagtgaaaataagaatgtgtcagtagacatggaaaagctacagccgttgtatgaaactcttaaacagaggggagaggaaatgattgctagatctggggggactgataaagacatatctgccaaagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagagaccataagggaagaaatagatggactacaggaggagctggatatagttattaacctaggttctgaactcattgcggcatgtggggagcctgataaacccattgtcaagaagagtatagatgagttaaattcagcatgggattctctaaataaagcttggaaagaccggattgacaaacttgaggaggcaatgcaggctgccgttcagtaccaggatggactgcaggcggtatttgactgggtagatattgcaggtggtaaattagcttcaatgtctccaattggaacagatctcgaaactgtcaagcagcagattgaagagctaaagcaatttaagtctgaggcctatcaacagcagatagaaatggaaagactgaatcatcaagcagagcttttgctaaagaaagtaacagaagagagtgacaaacacactgttcaagacccattaatggaactgaaattgatatgggatagcctggaggagagaatcatcaacagacagcataaactggagggtgctctattagccttgggtcagttccaacatgccctggatgagctcctggcatggctgacacacaccgagggcttgctaagtgagcagaaacctgttggaggagaccctaaagccattgaaattgaacttgccaagcatcatgtgctccaaaatgatgtattagcccatcagtccacagtggaagccgttaataaagcaggaaatgatctaattgaatcaagtgcaggagaagaagcaagcaaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaaactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcagttccatgaagcttggagtaaacttatggagtggctagaagagtcagaaaagtctttggattctgaactggaaatcgcaaatgatccagacaaaataaaaacacaacttgcacaacataaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggcagaggaattccactcggtggtacatgccctcttggagtggctggctgaggcggagcaaaccctgcgtttccatggtgtcctcccagatgatgaggatgctctccggactctcattgatcagcataaagaattcatgaagaaactggaagaaaagagagctgaactaaataaagccaccactatgggcgacaccgttttggctatctgccaccccgactccatcactaccattaagcactggataacaatcatccgggcgaggtttgaggaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccagaccttcatggaggaaatgaccagaaaacagcctgatgttgataaagtaacgaagacctataagaggagagctgctgatccttcctcattacaatcccatattccagtcttggataagggacgagcaggaagaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacagggtaagttttcaaagtaattttggagactcccagcaactgcgactggtccggatcctgcggagtactgtgatggttcgtgttggaggtggatggatggcacttgatgagttcttagtgaaaaatgatccttgcagggttcatcatcatgggagtaaaatgttacgttcggaatcaaactcttcaattactactactcagcctactatagccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaatatatgg

SEQ ID NO: 9074 - DNA, 3150 bp, Homo sapiens
aaccttggagaagaggacgaaacatacggacctggagaatcccaaatcacagcacaaagtagggaactcttgaaggattcccctcaagatttagatctctctcacacagatctaggggagagtgatgtagattgtggtagcaccagcttagtagaaaatgtgacacttttgacacaatatgattcaggagaatgcaacattgcatctaaagaggaagtggaggctcctctttctgcccaggagagcgaaatgctctataagaagttctccctgaaattcgtatcagcaagaaagaaagcagcacccagaaaaacaggggcccaggcaggaatattggacacagtctgcaatggctttcagttggttcaggtattccagaaagaagagattgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagccttagaagatgacatcatcaatcacaataaacatttacaccaggctgttagcattggccagtccttaaaggttttgagctccagggaggataaagatatggtgcagagtaaattagacttctctcaagtatggtacattgagattcaagagaaaagtcacagcaggtctgagctcctccagcaggccttatgtaatgctaagatttttggggaagatgaagttgaactgatgaactggctgaatgaagtgcatgacaaactgagcaagctctcagtccaggattacagcactgaggggctatggaagcagcagtctgaacttcgggttctgcaagaggacatcttactcaggaaacaaaatgtagatcaggctttactaaatggtttagaactacttaaacaaaccacaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcagtttgaccaagcagctgatgctgagttatcctggattactgaaacagaaaaaaaattgatgtctctgggtgacatcaggcttgagcaagaccagacttctgctcagcttcaagttcaaaagacattcaccatggagattttgagacacaaggatattattgatgaccttgttaaatctgggcataaaatcatgaccgcatgcagtgaagaggaaaagcaatcaatgaagaaaaaactggacaaggtactgaagaactatgataccatctgccagattaattcagaaaggtatctgcagctggaacgggcacagtccctggttaaccaattctgggaaacatatgaagaactttggccatggctgacagaaacacaatcaatcatctctcagcttcccgccccagcccttgaatatgaaactctaaggcagcagcaggaagaacatcggcaactgcgtgagttgatagctgaacacaagcctcatatagataagatgaacaaaactgggccacagttactggaattgagccctggggaaggcttttctatccaagagaagtatgtggcagccgacaccctttacagtcaaattaaagaagatgtcaaaaagcgtgctgtggcactggatgaagccatttctcaatcaactcagttccatgacaagatagatcagatccttgagagcctggaacgcatcgtggaacgtctgaggcagccaccctctatctctgcagaggttgagaagatcaaggaacagatcagtgaaaataagaatgtgtcagtagacatggaaaagctacagccgttgtatgaaactcttaaacagaggggagaggaaatgattgctagatctggggggactgataaagacatatctgccaaagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagagaccataagggaagaaatagatggactacaggaggagctggatatagttattaacctaggttctgaactcattgcggcatgtggggagcctgataaacccattgtcaagaagagtatagatgagttaaattcaatgggattctctaaataa

SEQ ID NO: 9075 - DNA, 1964 bp, Homo sapiens
agagttaaagggaatatcaaggatggtggcagaattaaagggcaaacttaccttccatcccaggtctagtattcagtcccccttcctcccactctccaccctactgcgtgctcttacttattctgttggaacccagtgtagcttcctgagatttaaaatataggaagactcaaaactatgttacttcttggaatatagataattcagtactgatttaaataacaactgaatagcaaggaccttctggaacataatcttacattcacaaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggaggttacctgagggaataagtgcatccagccctgtggctgaagagcattccctcataaagctgtacgtaaatcagcttgatcacggtgcacgctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttgttctcagatttgtagtgcataggtgtgtgtttc

SEQ ID NO: 9076 - DNA, 1680 bp, Homo sapiens
agaggctggatttcatactcatagctctccctagaatttcagagagttctgttatgatctctgttgtaattaccaatttggttcaagtttgttctttaaatgaatatgcttagaattcacatatgttctggatgtactggaattaaaaggatttaagagatcatggtgtgcatgttctaggataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagctcggacggtgcttttggtggatgcgtctagatggataacatgacttcttctaccctaaaatattcctataatactttgagctgttctggttcctccagggtgcatggtacccattaacccaaaatatgattatttcccttttttcccattttcagtcattttggaatgttctctgtgaaccacagttgtgttgtttaaagctcacatttctttctgtcaccacagagattggcctacggtttctgttttgagggtgctgttcaataaagctgtgtacactaaatgtc

SEQ ID NO: 9077 - DNA, 1626 bp, Homo sapiens
gaatatcaaggatggtggcagaattaaagggcaaacttaccttccatcccaggtctagtattcagtcccccttcctcccactctccaccctactgcgtgctcttacttattctgttggaacccagtgtagcttcctgagatttaaaatataggaagactcaaaactatgttacttcttggaatatagataattcagtactgatttaaataacaactgaatagcaaggaccttctggaacataatcttacattcacaaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggaggttacctgagggaataagtgcatccagccctgtggctgaagagcattccctcataaagctgtacgtaaatcagcttgatcacggtgcacgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacag

SEQ ID NO: 9078 - DNA, 3201 bp, Homo sapiens
acagtacacaccaggatctagaggctggatttcatactcatagctctccctagaatttcagagagttctgttatgatctctgttgtaattaccaatttggttcaagtttgttctttaaatgaatatgcttagaattcacatatgttctggatgtactggaattaaaaggatttaagagatcatggtgtgcatgttctaggataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatg

SEQ ID NO: 9079 - DNA, 1880 bp, Homo sapiens
gtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttaggtagggttgacaaacttgcattagctgaaccagggcagtatcgatgccactcccctccaaaggtgagacgtgagaaccatctgccagtcacttacgcataaacccccaagctcacagccagctcctggctccctaaccccacggttccacacggctgtgtggcagctgcaacagtggtgtggttccgtcatgaattcttctcaaagatttgacatgctccactccggtaactttggtgagttgagagctttcttgtttgttttccctcctttaccacccagaaatccatttgagtctgctccttgtggttaaggactggcgtttgcagggaggtgcggactctcctgcggggctcacgggaaactcttccctcttcgtgcgacaggcatttaggggcgtgcctgccatgggcaaagccatggtgtgtgttcagctcttggcctgtgttgtaaacttagttgcacttcagttcctttcatcccttcacaaaattttgtttcacattcatgcagcaaatatgggctgaggtgccagacctgtacctgggcttggtgcgtttcaaatttcagaccagttctttgggctgggtcaaggcaaagctcagtcgtcccagcagcacctcagccatctgtagaaggttctaccattaccacggtttcagcttcctctaaacttctcacccgcttctcctggcaatctgtcagaacggtgtcatcctggggaagagaaggagcttgggtgcatttgccctcatcctgagaaggccagaatactggagaccagcgtgaaccctcacccagagtcaggggaagatttagaaacagtgacacctgcatatagaattttgattccttgaagagcctatttagttccataaaattggagaactgctgaaggtcagtaattccgactttctcagcagtggtgtctctgaattactgcaaagggtaaaaaaaaaaaaaa

SEQ ID NO: 9080 - DNA, 1403 bp, Homo sapiens
acgcggaaggggctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggtaaactgaga

SEQ ID NO: 9081 - DNA, 1395 bp, Homo sapiens
gcggaaggggctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagagaaaagaactggaggtgaccttccgatctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggt

SEQ ID NO: 9082 - DNA, 1392 bp, Homo sapiens
gcggaaggggctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggagaagattgagaacattcaaaactgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggt

SEQ ID NO: 9083 - DNA, 1931 bp, Homo sapiens
gcggaaggggctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagagtaaagaattgggtacaggcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttaggtagggttgacaaacttgcattagctgaaccagggcagtatcgatgccactcccctccaaaggtgagacgtgagaaccatctgccagtcacttacgcataaacccccaagctcacagccagctcctggctccctaaccccacggttccacacggctgtgtggcagctgcaacagtggtgtggttccgtcatgaattcttctcaaagatttgacatgctccactccggtaactttggtgagttgagagctttcttgtttgttttccctcctttaccacccagaaatccatttgagtctgctccttgtggttaaggactggcgtttgcagggaggtgcggactctcctgcggggctcacgggaaactcttccctcttcgtgcgacaggcatttaggggcgtgcctgccatgggcaaagccatggtgtgtgttcagctcttggcctgtgttgtaaacttagttgcacttcagttcctttcatcccttcacaaaattttgtttcacattcatgcagcaaatatgggctgaggtgccagacctgtacctgggcttggtgcgtttcaaatttcagaccagttctttgggctgggtcaaggcaaagctcagtcgtcccagcagcacctcagccatctgtagaaggttctaccattaccacggtttcagcttcctctaaacttctcacccgcttctcctggcaatctgtcagaacggtgtcatcctggggaagagaaggagcttgggtgcatttgccctcatcctgagaaggccagaatactggagaccagcgtgaaccctcacccagagtcaggggaagatttagaaacagtgacacctgcatatagaattttgattccttgaagagcctatttagttccataaaattggagaactgctgaaggtcagtaattccgactttctcagcagtggtgtctctgaattactgcaaagggt

SEQ ID NO: 9084 - DNA, 1404 bp, Homo sapiens
ggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccagttggctaaatcaagaacagttttaataagtgtttcttttgggcaggactgttccatttttgccaaagtactctgctggattagaattacttagcaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgagagcccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaacagctaacaataaagtgtgaggacggt

SEQ ID NO: 9085 - DNA, 1306 bp, Homo sapiens
ctggggttgcggcgcggcggcgaggaccagaccgggggcggggccggtagtgggagtgcggggcgcgcggtgacagcgcggggttggcggcgtgggacccagggggcgacagaggcagcagcagcccgaggcctgaggagaggagaccggcggcggcggcaatgctggagacccttcgcgagcggctgctgagcgtgcagcaggatttcacctccgggctgaagactttaagtgacaagtcaagagaagcaaaagtgaaaagcaaacccaggtatgaggatacatgggctgcacttcacagaagagccaaagactgtgcaagtgctggagagctggtggatagcgaggtggtcatgctttctgcgcactgggagaagaaaaagacaagcctcgtggagctgcaagagcagctccagcagctcccagctttaatcgcagacttagaatccatgacagcaaatctgactcatttagaggcgagttttgaggaggtagagaacaacctgctgcatctggaagacttatgtgggcagtgtgaattagaaagatgcaaacatatgcagtcccagcaactggagaattacaagaaaaataagaggaaggaacttgaaaccttcaaagctgaactagatgcagagcacgcccagaaggtcctggaaatggagcacacccagcaaatgaagctgaaggagcggcagaagttttttgaggaagccttccagcaggacatggagcagtacctgtccactggctacctgcagattgcagagcggcgaggcgacccataggcagcatgtcatccatggaagtgaacgtggacatgctggagcagatggacctgatggacatatcggaccaggaggccctggacgtcttcctgaactctggaggagaagagaacactgtgctgtcccccgccttagggcctgaatccagtacctgtcagaatgagattaccctccaggttccaaatccctcagaattaagagccaagccaccttcttcttcctccacctgcaccgactcggccacccgggacatcagtgagggtggggagtcccccgttgttcagtccgatgaggaggaagttcaggtggacactgccctggccacatcacacactgacagagaggccactccggatggtggtgaggacagcgactcttaaattgggacatgggcgttgtctggccacactggaatccagttttggctgtatgcggaattccacctggaaagccaggttgttttatagaggttcttgatttttacataattgccaataatgtgtgagaaacttaaagaa

SEQ ID NO: 9086 - DNA, 6199 bp, Homo sapiens
ggatttcatactcatagctctccctagaatttcagagagttctgttatgatctctgttgtaattaccaatttggttcaagtttgttctttaaatgaatatgcttagaattcacatatgttctggatgtactggaattaaaaggatttaagagatcatggtgtgcatgttctaggataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgctggacaatatgcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttgttctcagatttgtagtgcataggtgtgtgtttcaagaaggaaaaaaaaagacttctgttcaaagttaacttatcagctacatcctctgtaacgtggttcatccctggttaaaaagcaaacaaacacaggctgaaaacccatgctgctgttatacacaatggcagtattaacaagcattttaaacctttgcacatgatattgaacctgttcagtttacaatgacaatattaatactgtttatagctagaagtttgatttctgaattctttgagattttagcaaaacagtttattatacactgtacatttttttcacagcaattggaaaaaaacaaccacttgcaatcattcaataaccctgaagaatttggttcctgagtgtacaaactcagagcccggaagccaagaagggtccttggcctgcacggtctgtagttgactccaagtctctgtgagcagtgacttgaaccaaacacaccaggaataatccattctttggggcctctttccaactcgaggttgttttctttcaagatactctaatcagccatagaatttagtgtaaatatttttttttccaaatagatatcatattcaaaaaaggcagcattcaaattatatagaatctagtttttaaaatcagcacagatcttcttaaaaactgtgaactatgttttgaaatactcgttactaaagctgtttataaaccacaggtgccataagatccccaaacggactaaagttatctctgctcttccatggtcttgttcctctcgttttggctttaggaagcatgtctttaacagcaccgctcgttcacaagttcccccatcaagttgtttggaggccttcagctttaaatgtacaggcttaaagtgcgcttgcaaacgtttgctctcctttttttctgaatgttgattgccttagctggccacctggtgttctgcatgtagccttctgtggtcatgtgaaaggagacaggctcttctaagttgagttgggatttttgcactcagtgaaaagctgaagtgcaaaagagctatcaaagacaagaggataaaagactgggatagtcttttccaaggaccctctttagagggccctaaagacctcctttgggaattctggggaaaaagaaaaagtaatcttctacttgcttcaagatttgatttttttaaaaaagcctgcgacctattcaatacattatgcttaaattagcagtttctctggaattcctgtctctcctttaaaagaaaggagagaacattttagaacaatagttctcaaagtgtgttccccggacaagcagcatctgcaacacttaggaaggtcttcgaaatactaatttgtaagccccacctcaggcctactgaatcagaagctctgggggttgggtccagaagtctgttttagtcaaccctctaggtgattctgatgctcgctaaaggttgagaactactgctttagaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagtattgaaaaccactacatcccagctacctataatgctgtcagctcaaaatcatagccaggtagttcttgaactcagaacttaaatcctgcacgtggcactccaccactgactggaccgagctggcatatgttgtttctttgtgtttctacatcaaaatgttcgtctaagatttgaactgttctgctgataaccttccccgttgtcatagctatttcattgccaaccaactccatcacatggttgttgatatcgtcatataaagccattgcaaggactctggaaactgccgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaac

SEQ ID NO: 9087 - DNA, 4363 bp, Homo sapiens
aatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgttgatacttggcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaactaacagtggaggggcctgccgacctgcggttttctcattgcttttgctctaatgtatgttcatgcttcagtttggaaagagaaaaaagtcatactaatttgcttctttttcaatgtagtgcttgaattgagatatataaatttagcattttttataactatcactactatccacatcaaaagaagaactatgacatcttttagaaaagggaacgaattgtcatttattggaaacattttagatccccagaggtataagtttcaaaccagtcttagcttttcaagttgttgatcagacccttctcttaacagagagataccacagtcactagagataccctgaggttcatgtcatcccaaaacccacagcactcagaagctaacctctacacccactcacactgtgagtattcagttcggtttcattttactgaaaacctgtgaaacctctttttataaaaatcaggcaattaaatcccttttcatcacacaattattgagccttgttccccatggctcaccaaaatgtgctcaattttgtgagagaaagactgtactccataactgactattcacgtcccatctttttggctcttccccaaagcagaatccttactgttggttgacagtaatctctttttaaaaagtaactctcagctttttccttagcaccagagcctttcggctccgggagacgagagggtcattacatacttttttttttttctggaaataggggcattgtgactttatagcctaaactggagctgtctgaacctgtggtcaggctcaagagccagcagggggagcagcaaactcaaaaaaaaaaacaaattaaattaaattaaattaaattaaatagaagcaaaataaaagcagctttaatttcaagtgcatgtaccacgctatgtatgacaatatatcccactcactagcattatttaaaagtttcacattatttccatggatcaattagaaccacaacctgtccaatttcaacgtatctttcatttcttctgtatgctcttttctattattcattatgtgtgtttgtgtgtaacaaagaatgtttggaaaatgctggacacatttttacccttcattcccatggtctgtaaaaaaggaaagtgtaaaatcaatctgtaatgtcagacaataaagataatgtattacattattttgtattttgtgaaaaaaattactttactaaattaaagtcaaattttaacagaagacagtccccctgggtgaaggacacataacacatacagcctgtataattgcccatgaatgcatacatggggtattgctattgtatttccaatacacttagatcatggtaaagaaaaatgccttcttcatgatacttctctgcaaatggcttctttcctctcctgtctcttatttagcatgtgcatagaaaaaggaaataaggttcaattataacctccctcctcctagcagagagagagggcaatcatcctgtcgtcatcagccttgctttagccatttcccttggggatactttccaggccatttcccaggcagcaggatcttgaaaggctcctatggaccaggaagttcgtaaacagatggatgcacagagccaaactgtggcagtgcccccaaggtggcgccactgccccctcaccttccagctcctctccaccaagcccctcagcagcttctgcatctcagggggccaacagcgggtactgcggtgtcggtacccaaggaccagggcccacgtcacccagatgtcagcaatacatcgtctgggtagtggcagagtttgcctatttcacttatttatcttttttgcttttatacacaagcctcttttcaaaaaggacctgaggcagcttacaacaaaagatataaacagtgacttcataaaattgaaatagaaaaatcaaaaactaaagaaaataaaatgtgaatatgctaatcttaagggacaaggatgttactctgcatgttctggcaatgaagcaaaaaaaaaaaaaaaaggaaaattatcggtggttttatcagtacagaaataccacttctcaggggaacaaaatttctgttggcataaaatatgaaagaaagtcttcactgggagctttataggagtactggacgatagaaaaggaaaaaaagcagtcatagatttcatgtggctgtttcttatactgacctcagtcaaaattaaaagcagaaccttatcaatcccagccctatagaggcggttctgcaaggaaataaacaaatgctgtccaaatatagacttctcatggtaaaacatgatctaaggagagaatttagaggttttagactggcatctgcttctaaattctgtttttatttatgagtgtttctcccctttggggacattgtctttgtaaaaccaaacttagaacacccccacacaacaaattgtgctggatttaataacctctacttgctttatcataagtctgtgtggttcaatgtagtgttttattatactggcatatataatttctacttacattgtttcttgttagaggtaatgcatgaatttatccctctcgaggagagaacatgaattaaaaaaaatagtgcctgtaatataatgtgatgattatgatatcacaagcaataaatttttttttacaaaacttg

SEQ ID NO: 9088 - DNA, 6522 bp, Homo sapiens
aggatgagatcatagtttcaggatcctcaggaaaccctggtactggcagcagccagcctctgctgtgcccacatgacccacaactctggcagcggacccggcacttccaacattattaaataataagaaagcggctcctactccaggctcaaacctccctgcagaccaatggacaccttctaagagtttggcgagtcagtgactgaagcgcccgtccattccaagataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgttgatacttggcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttgttctcagatttgtagtgcataggtgtgtgtttcaagaaggaaaaaaaaagacttctgttcaaagttaacttatcagctacatcctctgtaacgtggttcatccctggttaaaaagcaaacaaacacaggctgaaaacccatgctgctgttatacacaatggcagtattaacaagcattttaaacctttgcacatgatattgaacctgttcagtttacaatgacaatattaatactgtttatagctagaagtttgatttctgaattctttgagattttagcaaaacagtttattatacactgtacatttttttcacagcaattggaaaaaaacaaccacttgcaatcattcaataaccctgaagaatttggttcctgagtgtacaaactcagagcccggaagccaagaagggtccttggcctgcacggtctgtagttgactccaagtctctgtgagcagtgacttgaaccaaacacaccaggaataatccattctttggggcctctttccaactcgaggttgttttctttcaagatactctaatcagccatagaatttagtgtaaatatttttttttccaaatagatatcatattcaaaaaaggcagcattcaaattatatagaatctagtttttaaaatcagcacagatcttcttaaaaactgtgaactatgttttgaaatactcgttactaaagctgtttataaaccacaggtgccataagatccccaaacggactaaagttatctctgctcttccatggtcttgttcctctcgttttggctttaggaagcatgtctttaacagcaccgctcgttcacaagttcccccatcaagttgtttggaggccttcagctttaaatgtacaggcttaaagtgcgcttgcaaacgtttgctctcctttttttctgaatgttgattgccttagctggccacctggtgttctgcatgtagccttctgtggtcatgtgaaaggagacaggctcttctaagttgagttgggatttttgcactcagtgaaaagctgaagtgcaaaagagctatcaaagacaagaggataaaagactgggatagtcttttccaaggaccctctttagagggccctaaagacctcctttgggaattctggggaaaaagaaaaagtaatcttctacttgcttcaagatttgatttttttaaaaaagcctgcgacctattcaatacattatgcttaaattagcagtttctctggaattcctgtctctcctttaaaagaaaggagagaacattttagaacaatagttctcaaagtgtgttccccggacaagcagcatctgcaacacttaggaaggtcttcgaaatactaatttgtaagccccacctcaggcctactgaatcagaagctctgggggttgggtccagaagtctgttttagtcaaccctctaggtgattctgatgctcgctaaaggttgagaactactgctttagaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagtattgaaaaccactacatcccagctacctataatgctgtcagctcaaaatcatagccaggtagttcttgaactcagaacttaaatcctgcacgtggcactccaccactgactggaccgagctggcatatgttgtttctttgtgtttctacatcaaaatgttcgtctaagatttgaactgttctgctgataaccttccccgttgtcatagctatttcattgccaaccaactccatcacatggttgttgatatcgtcatataaagccattgcaaggactctggaaactgccgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaacactatatcttgggtggtttattcctttgtttcagtgaatctttcctaaagcaacgtggagtcagtctgttgaaagaaggaaggcaggtacttgcagtttaaagcaggacccattgatggaatattgagccaccgaggcaaaatagctcaccttctcttgccttgggggatgcatggtttttaccattctactgttttattagcatctgtgagcatctaatagaaatactattctgctatttatggaaatccttattataattgatatggaagtgagtttgaaattctaacagctaacatatttcatgtttgtatcacacactgttcttaacactttatgtgacttcactcaattctttgaatcctctgcatctagccatgtattctgcaaatattaagtgctcaatggtttttttgttgaattactgaataaatgaattagtggtg

SEQ ID NO: 9089 - DNA, 1706 bp, Homo sapiens
caggaaaccctggtactggcagcagccagcctctgctgtgcccacatgacccacaactctggcagcggacccggcacttccaacattattaaataataagaaagcggctcctactccaggctcaaacctccctgcagaccaatggacaccttctaagagtttggcgagtcagtgactgaagcgcccgtccattccaagataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgttgatacttggcctcccagacctgtaaccagcatgaacgacaccctgttctcccactctgttccctcctcaggaagtccttttattaccaggagctcggacggtgcttttggtggatgcgtctagatggataacatgacttcttctaccctaaaatattcctataatactttgagctgttctggttcctccagggtgcatggtacccattaacccaaaatatgattatttcccttttttcccattttcagtcattttggaatgttctctgtgaaccacagttgtgttgtttaaagctcacatttctttctgtcaccacagagattggcctacggtttctgttttgagggtgctgttcaataaagctgtgtacactaaatgtc

SEQ ID NO: 9090 - DNA, 4518 bp, Homo sapiens
ttgagcacaaggggaagaatgaacacagctttttattgaagttaaaggttactttggagtttgtttggaaatgtgtaaggtcaaatactatagttttcagcatatgtagtacttcagaggaagaattaaggggcatgttggtgcatttaactacaaaaccagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggagtaagttatgtcccctactgcaggtcttaactaacagtggaggggcctgccgacctgcggttttctcattgcttttgctctaatgtatgttcatgcttcagtttggaaagagaaaaaagtcatactaatttgcttctttttcaatgtagtgcttgaattgagatatataaatttagcattttttataactatcactactatccacatcaaaagaagaactatgacatcttttagaaaagggaacgaattgtcatttattggaaacattttagatccccagaggtataagtttcaaaccagtcttagcttttcaagttgttgatcagacccttctcttaacagagagataccacagtcactagagataccctgaggttcatgtcatcccaaaacccacagcactcagaagctaacctctacacccactcacactgtgagtattcagttcggtttcattttactgaaaacctgtgaaacctctttttataaaaatcaggcaattaaatcccttttcatcacacaattattgagccttgttccccatggctcaccaaaatgtgctcaattttgtgagagaaagactgtactccataactgactattcacgtcccatctttttggctcttccccaaagcagaatccttactgttggttgacagtaatctctttttaaaaagtaactctcagctttttccttagcaccagagcctttcggctccgggagacgagagggtcattacatacttttttttttttctggaaataggggcattgtgactttatagcctaaactggagctgtctgaacctgtggtcaggctcaagagccagcagggggagcagcaaactcaaaaaaaaaaacaaattaaattaaattaaattaaattaaatagaagcaaaataaaagcagctttaatttcaagtgcatgtaccacgctatgtatgacaatatatcccactcactagcattatttaaaagtttcacattatttccatggatcaattagaaccacaacctgtccaatttcaacgtatctttcatttcttctgtatgctcttttctattattcattatgtgtgtttgtgtgtaacaaagaatgtttggaaaatgctggacacatttttacccttcattcccatggtctgtaaaaaaggaaagtgtaaaatcaatctgtaatgtcagacaataaagataatgtattacattattttgtattttgtgaaaaaaattactttactaaattaaagtcaaattttaacagaagacagtccccctgggtgaaggacacataacacatacagcctgtataattgcccatgaatgcatacatggggtattgctattgtatttccaatacacttagatcatggtaaagaaaaatgccttcttcatgatacttctctgcaaatggcttctttcctctcctgtctcttatttagcatgtgcatagaaaaaggaaataaggttcaattataacctccctcctcctagcagagagagagggcaatcatcctgtcgtcatcagccttgctttagccatttcccttggggatactttccaggccatttcccaggcagcaggatcttgaaaggctcctatggaccaggaagttcgtaaacagatggatgcacagagccaaactgtggcagtgcccccaaggtggcgccactgccccctcaccttccagctcctctccaccaagcccctcagcagcttctgcatctcagggggccaacagcgggtactgcggtgtcggtacccaaggaccagggcccacgtcacccagatgtcagcaatacatcgtctgggtagtggcagagtttgcctatttcacttatttatcttttttgcttttatacacaagcctcttttcaaaaaggacctgaggcagcttacaacaaaagatataaacagtgacttcataaaattgaaatagaaaaatcaaaaactaaagaaaataaaatgtgaatatgctaatcttaagggacaaggatgttactctgcatgttctggcaatgaagcaaaaaaaaaaaaaaaaggaaaattatcggtggttttatcagtacagaaataccacttctcaggggaacaaaatttctgttggcataaaatatgaaagaaagtcttcactgggagctttataggagtactggacgatagaaaaggaaaaaaagcagtcatagatttcatgtggctgtttcttatactgacctcagtcaaaattaaaagcagaaccttatcaatcccagccctatagaggcggttctgcaaggaaataaacaaatgctgtccaaatatagacttctcatggtaaaacatgatctaaggagagaatttagaggttttagactggcatctgcttctaaattctgtttttatttatgagtgtttctcccctttggggacattgtctttgtaaaaccaaacttagaacacccccacacaacaaattgtgctggatttaataacctctacttgctttatcataagtctgtgtggttcaatgtagtgttttattatactggcatatataatttctacttacattgtttcttgttagaggtaatgcatgaatttatccctctcgaggagagaacatgaattaaaaaaaatagtgcctgtaatataatgtgatgattatgatatcacaagcaataaatttttttttacaaaacttgaa

SEQ ID NO: 9091 - DNA, 6094 bp, Homo sapiens
ggatttcatactcatagctctccctagaatttcagagagttctgttatgatctctgttgtaattaccaatttggttcaagtttgttctttaaatgaatatgcttagaattcacatatgttctggatgtactggaattaaaaggatttaagagatcatggtgtgcatgttctaggataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaaggcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttgttctcagatttgtagtgcataggtgtgtgtttcaagaaggaaaaaaaaagacttctgttcaaagttaacttatcagctacatcctctgtaacgtggttcatccctggttaaaaagcaaacaaacacaggctgaaaacccatgctgctgttatacacaatggcagtattaacaagcattttaaacctttgcacatgatattgaacctgttcagtttacaatgacaatattaatactgtttatagctagaagtttgatttctgaattctttgagattttagcaaaacagtttattatacactgtacatttttttcacagcaattggaaaaaaacaaccacttgcaatcattcaataaccctgaagaatttggttcctgagtgtacaaactcagagcccggaagccaagaagggtccttggcctgcacggtctgtagttgactccaagtctctgtgagcagtgacttgaaccaaacacaccaggaataatccattctttggggcctctttccaactcgaggttgttttctttcaagatactctaatcagccatagaatttagtgtaaatatttttttttccaaatagatatcatattcaaaaaaggcagcattcaaattatatagaatctagtttttaaaatcagcacagatcttcttaaaaactgtgaactatgttttgaaatactcgttactaaagctgtttataaaccacaggtgccataagatccccaaacggactaaagttatctctgctcttccatggtcttgttcctctcgttttggctttaggaagcatgtctttaacagcaccgctcgttcacaagttcccccatcaagttgtttggaggccttcagctttaaatgtacaggcttaaagtgcgcttgcaaacgtttgctctcctttttttctgaatgttgattgccttagctggccacctggtgttctgcatgtagccttctgtggtcatgtgaaaggagacaggctcttctaagttgagttgggatttttgcactcagtgaaaagctgaagtgcaaaagagctatcaaagacaagaggataaaagactgggatagtcttttccaaggaccctctttagagggccctaaagacctcctttgggaattctggggaaaaagaaaaagtaatcttctacttgcttcaagatttgatttttttaaaaaagcctgcgacctattcaatacattatgcttaaattagcagtttctctggaattcctgtctctcctttaaaagaaaggagagaacattttagaacaatagttctcaaagtgtgttccccggacaagcagcatctgcaacacttaggaaggtcttcgaaatactaatttgtaagccccacctcaggcctactgaatcagaagctctgggggttgggtccagaagtctgttttagtcaaccctctaggtgattctgatgctcgctaaaggttgagaactactgctttagaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagtattgaaaaccactacatcccagctacctataatgctgtcagctcaaaatcatagccaggtagttcttgaactcagaacttaaatcctgcacgtggcactccaccactgactggaccgagctggcatatgttgtttctttgtgtttctacatcaaaatgttcgtctaagatttgaactgttctgctgataaccttccccgttgtcatagctatttcattgccaaccaactccatcacatggttgttgatatcgtcatataaagccattgcaaggactctggaaactgccgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaac

SEQ ID NO: 9092 - DNA, 2232 bp, Homo sapiens
atgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgttgatacttggcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttga

SEQ ID NO: 9093 - DNA, 6490 bp, Homo sapiens
agaggctggatttcatactcatagctctccctagaatttcagagagttctgttatgatctctgttgtaattaccaatttggttcaagtttgttctttaaatgaatatgcttagaattcacatatgttctggatgtactggaattaaaaggatttaagagatcatggtgtgcatgttctaggataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaaggaagaagaactgaagcagggaactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttgttctcagatttgtagtgcataggtgtgtgtttcaagaaggaaaaaaaaagacttctgttcaaagttaacttatcagctacatcctctgtaacgtggttcatccctggttaaaaagcaaacaaacacaggctgaaaacccatgctgctgttatacacaatggcagtattaacaagcattttaaacctttgcacatgatattgaacctgttcagtttacaatgacaatattaatactgtttatagctagaagtttgatttctgaattctttgagattttagcaaaacagtttattatacactgtacatttttttcacagcaattggaaaaaaacaaccacttgcaatcattcaataaccctgaagaatttggttcctgagtgtacaaactcagagcccggaagccaagaagggtccttggcctgcacggtctgtagttgactccaagtctctgtgagcagtgacttgaaccaaacacaccaggaataatccattctttggggcctctttccaactcgaggttgttttctttcaagatactctaatcagccatagaatttagtgtaaatatttttttttccaaatagatatcatattcaaaaaaggcagcattcaaattatatagaatctagtttttaaaatcagcacagatcttcttaaaaactgtgaactatgttttgaaatactcgttactaaagctgtttataaaccacaggtgccataagatccccaaacggactaaagttatctctgctcttccatggtcttgttcctctcgttttggctttaggaagcatgtctttaacagcaccgctcgttcacaagttcccccatcaagttgtttggaggccttcagctttaaatgtacaggcttaaagtgcgcttgcaaacgtttgctctcctttttttctgaatgttgattgccttagctggccacctggtgttctgcatgtagccttctgtggtcatgtgaaaggagacaggctcttctaagttgagttgggatttttgcactcagtgaaaagctgaagtgcaaaagagctatcaaagacaagaggataaaagactgggatagtcttttccaaggaccctctttagagggccctaaagacctcctttgggaattctggggaaaaagaaaaagtaatcttctacttgcttcaagatttgatttttttaaaaaagcctgcgacctattcaatacattatgcttaaattagcagtttctctggaattcctgtctctcctttaaaagaaaggagagaacattttagaacaatagttctcaaagtgtgttccccggacaagcagcatctgcaacacttaggaaggtcttcgaaatactaatttgtaagccccacctcaggcctactgaatcagaagctctgggggttgggtccagaagtctgttttagtcaaccctctaggtgattctgatgctcgctaaaggttgagaactactgctttagaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagtattgaaaaccactacatcccagctacctataatgctgtcagctcaaaatcatagccaggtagttcttgaactcagaacttaaatcctgcacgtggcactccaccactgactggaccgagctggcatatgttgtttctttgtgtttctacatcaaaatgttcgtctaagatttgaactgttctgctgataaccttccccgttgtcatagctatttcattgccaaccaactccatcacatggttgttgatatcgtcatataaagccattgcaaggactctggaaactgccgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaacactatatcttgggtggtttattcctttgtttcagtgaatctttcctaaagcaacgtggagtcagtctgttgaaagaaggaaggcaggtacttgcagtttaaagcaggacccattgatggaatattgagccaccgaggcaaaatagctcaccttctcttgccttgggggatgcatggtttttaccattctactgttttattagcatctgtgagcatctaatagaaatactattctgctatttatggaaatccttattataattgatatggaagtgagtttgaaattctaacagctaacatatttcatgtttgtatcacacactgttcttaacactttatgtgacttcactcaattctttgaatcctctgcatctagccatgtattctgcaaatattaagtgctcaatggtttttttgttgaattactgaataaatgaattagtggtg

SEQ ID NO: 9094 - DNA, 6522 bp, Homo sapiens
aggatgagatcatagtttcaggatcctcaggaaaccctggtactggcagcagccagcctctgctgtgcccacatgacccacaactctggcagcggacccggcacttccaacattattaaataataagaaagcggctcctactccaggctcaaacctccctgcagaccaatggacaccttctaagagtttggcgagtcagtgactgaagcgcccgtccattccaagataaataggatttaccaatccttggatgaagtgcttgggaagtctttaagtgccataatcaactgccatttcaaagaatatagatggttttgaaaagttcatgctgtcccttcattgaattttagaatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtttgttttaggcctcccagacctgtaaccagcatgaacgacaccctgttctcccactctgttccctcctcaggaagtccttttattaccaggagcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttgttctcagatttgtagtgcataggtgtgtgtttcaagaaggaaaaaaaaagacttctgttcaaagttaacttatcagctacatcctctgtaacgtggttcatccctggttaaaaagcaaacaaacacaggctgaaaacccatgctgctgttatacacaatggcagtattaacaagcattttaaacctttgcacatgatattgaacctgttcagtttacaatgacaatattaatactgtttatagctagaagtttgatttctgaattctttgagattttagcaaaacagtttattatacactgtacatttttttcacagcaattggaaaaaaacaaccacttgcaatcattcaataaccctgaagaatttggttcctgagtgtacaaactcagagcccggaagccaagaagggtccttggcctgcacggtctgtagttgactccaagtctctgtgagcagtgacttgaaccaaacacaccaggaataatccattctttggggcctctttccaactcgaggttgttttctttcaagatactctaatcagccatagaatttagtgtaaatatttttttttccaaatagatatcatattcaaaaaaggcagcattcaaattatatagaatctagtttttaaaatcagcacagatcttcttaaaaactgtgaactatgttttgaaatactcgttactaaagctgtttataaaccacaggtgccataagatccccaaacggactaaagttatctctgctcttccatggtcttgttcctctcgttttggctttaggaagcatgtctttaacagcaccgctcgttcacaagttcccccatcaagttgtttggaggccttcagctttaaatgtacaggcttaaagtgcgcttgcaaacgtttgctctcctttttttctgaatgttgattgccttagctggccacctggtgttctgcatgtagccttctgtggtcatgtgaaaggagacaggctcttctaagttgagttgggatttttgcactcagtgaaaagctgaagtgcaaaagagctatcaaagacaagaggataaaagactgggatagtcttttccaaggaccctctttagagggccctaaagacctcctttgggaattctggggaaaaagaaaaagtaatcttctacttgcttcaagatttgatttttttaaaaaagcctgcgacctattcaatacattatgcttaaattagcagtttctctggaattcctgtctctcctttaaaagaaaggagagaacattttagaacaatagttctcaaagtgtgttccccggacaagcagcatctgcaacacttaggaaggtcttcgaaatactaatttgtaagccccacctcaggcctactgaatcagaagctctgggggttgggtccagaagtctgttttagtcaaccctctaggtgattctgatgctcgctaaaggttgagaactactgctttagaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagtattgaaaaccactacatcccagctacctataatgctgtcagctcaaaatcatagccaggtagttcttgaactcagaacttaaatcctgcacgtggcactccaccactgactggaccgagctggcatatgttgtttctttgtgtttctacatcaaaatgttcgtctaagatttgaactgttctgctgataaccttccccgttgtcatagctatttcattgccaaccaactccatcacatggttgttgatatcgtcatataaagccattgcaaggactctggaaactgccgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaacactatatcttgggtggtttattcctttgtttcagtgaatctttcctaaagcaacgtggagtcagtctgttgaaagaaggaaggcaggtacttgcagtttaaagcaggacccattgatggaatattgagccaccgaggcaaaatagctcaccttctcttgccttgggggatgcatggtttttaccattctactgttttattagcatctgtgagcatctaatagaaatactattctgctatttatggaaatccttattataattgatatggaagtgagtttgaaattctaacagctaacatatttcatgtttgtatcacacactgttcttaacactttatgtgacttcactcaattctttgaatcctctgcatctagccatgtattctgcaaatattaagtgctcaatggtttttttgttgaattactgaataaatgaattagtggtg

SEQ ID NO: 9095 - DNA, 6343 bp, Homo sapiens
aatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgtttgttttaggcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttgttctcagatttgtagtgcataggtgtgtgtttcaagaaggaaaaaaaaagacttctgttcaaagttaacttatcagctacatcctctgtaacgtggttcatccctggttaaaaagcaaacaaacacaggctgaaaacccatgctgctgttatacacaatggcagtattaacaagcattttaaacctttgcacatgatattgaacctgttcagtttacaatgacaatattaatactgtttatagctagaagtttgatttctgaattctttgagattttagcaaaacagtttattatacactgtacatttttttcacagcaattggaaaaaaacaaccacttgcaatcattcaataaccctgaagaatttggttcctgagtgtacaaactcagagcccggaagccaagaagggtccttggcctgcacggtctgtagttgactccaagtctctgtgagcagtgacttgaaccaaacacaccaggaataatccattctttggggcctctttccaactcgaggttgttttctttcaagatactctaatcagccatagaatttagtgtaaatatttttttttccaaatagatatcatattcaaaaaaggcagcattcaaattatatagaatctagtttttaaaatcagcacagatcttcttaaaaactgtgaactatgttttgaaatactcgttactaaagctgtttataaaccacaggtgccataagatccccaaacggactaaagttatctctgctcttccatggtcttgttcctctcgttttggctttaggaagcatgtctttaacagcaccgctcgttcacaagttcccccatcaagttgtttggaggccttcagctttaaatgtacaggcttaaagtgcgcttgcaaacgtttgctctcctttttttctgaatgttgattgccttagctggccacctggtgttctgcatgtagccttctgtggtcatgtgaaaggagacaggctcttctaagttgagttgggatttttgcactcagtgaaaagctgaagtgcaaaagagctatcaaagacaagaggataaaagactgggatagtcttttccaaggaccctctttagagggccctaaagacctcctttgggaattctggggaaaaagaaaaagtaatcttctacttgcttcaagatttgatttttttaaaaaagcctgcgacctattcaatacattatgcttaaattagcagtttctctggaattcctgtctctcctttaaaagaaaggagagaacattttagaacaatagttctcaaagtgtgttccccggacaagcagcatctgcaacacttaggaaggtcttcgaaatactaatttgtaagccccacctcaggcctactgaatcagaagctctgggggttgggtccagaagtctgttttagtcaaccctctaggtgattctgatgctcgctaaaggttgagaactactgctttagaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagtattgaaaaccactacatcccagctacctataatgctgtcagctcaaaatcatagccaggtagttcttgaactcagaacttaaatcctgcacgtggcactccaccactgactggaccgagctggcatatgttgtttctttgtgtttctacatcaaaatgttcgtctaagatttgaactgttctgctgataaccttccccgttgtcatagctatttcattgccaaccaactccatcacatggttgttgatatcgtcatataaagccattgcaaggactctggaaactgccgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaacactatatcttgggtggtttattcctttgtttcagtgaatctttcctaaagcaacgtggagtcagtctgttgaaagaaggaaggcaggtacttgcagtttaaagcaggacccattgatggaatattgagccaccgaggcaaaatagctcaccttctcttgccttgggggatgcatggtttttaccattctactgttttattagcatctgtgagcatctaatagaaatactattctgctatttatggaaatccttattataattgatatggaagtgagtttgaaattctaacagctaacatatttcatgtttgtatcacacactgttcttaacactttatgtgacttcactcaattctttgaatcctctgcatctagccatgtattctgcaaatattaagtgctcaatggtttttttgttgaattactgaataaatgaattagtggtg

SEQ ID NO: 9096 - DNA, 6343 bp, Homo sapiens
aatgattgaagatagtgggaaaagaggaaataccatggcagaaagaagacagctgtttgcagagatgagggctcaagatctggatcgcatccgactctccacctacagaacagcatgcaagcttaggtttgttcagaagaaatgcaatttgcacctggtggacatatggaatgtcatagaagcattgcgggaaaatgctctgaacaacctggacccaaacactgaactcaacgtgtcccgcttagaggctgtgctctccactattttttaccagctcaacaaacggatgccaaccactcaccaaatccatgtggagcagtccatcagcctcctccttaacttcctgcttgcagcgtttgatccggaaggccatggtaaaatttcagtatttgctgtcaaaatggctttagccacattgtgtggagggaagatcatggacaaattaagatatattttctcaatgatttctgactccagtggggtgatggtttatggacgatatgaccaattccttcgggaagttctcaaactacccacggcagtttttgaaggtccttcatttggttacacagaacagtcagccagatcctgtttctcccaacagaaaaaagtcacgttaaatggtttcttggacacgcttatgtcagatcctcccccgcagtgtctggtctggttgcctcttctgcatcgactagcaaatgtggaaaatgtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatggaaatcacctgctaagaagctgactaatgcattaagcaagtccctgagctgtgcttccagccgtgaacctttgcaccccatgttcccagatcagcctgagaagccactcaacttggctcacatcgttgatacttggcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaagggatacagtacagcctgaatgtggcagacaggctagctgatgaacatgttctcatcgggttgtatgtcaacatgctccggaacaacccctcatgcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttgttctcagatttgtagtgcataggtgtgtgtttcaagaaggaaaaaaaaagacttctgttcaaagttaacttatcagctacatcctctgtaacgtggttcatccctggttaaaaagcaaacaaacacaggctgaaaacccatgctgctgttatacacaatggcagtattaacaagcattttaaacctttgcacatgatattgaacctgttcagtttacaatgacaatattaatactgtttatagctagaagtttgatttctgaattctttgagattttagcaaaacagtttattatacactgtacatttttttcacagcaattggaaaaaaacaaccacttgcaatcattcaataaccctgaagaatttggttcctgagtgtacaaactcagagcccggaagccaagaagggtccttggcctgcacggtctgtagttgactccaagtctctgtgagcagtgacttgaaccaaacacaccaggaataatccattctttggggcctctttccaactcgaggttgttttctttcaagatactctaatcagccatagaatttagtgtaaatatttttttttccaaatagatatcatattcaaaaaaggcagcattcaaattatatagaatctagtttttaaaatcagcacagatcttcttaaaaactgtgaactatgttttgaaatactcgttactaaagctgtttataaaccacaggtgccataagatccccaaacggactaaagttatctctgctcttccatggtcttgttcctctcgttttggctttaggaagcatgtctttaacagcaccgctcgttcacaagttcccccatcaagttgtttggaggccttcagctttaaatgtacaggcttaaagtgcgcttgcaaacgtttgctctcctttttttctgaatgttgattgccttagctggccacctggtgttctgcatgtagccttctgtggtcatgtgaaaggagacaggctcttctaagttgagttgggatttttgcactcagtgaaaagctgaagtgcaaaagagctatcaaagacaagaggataaaagactgggatagtcttttccaaggaccctctttagagggccctaaagacctcctttgggaattctggggaaaaagaaaaagtaatcttctacttgcttcaagatttgatttttttaaaaaagcctgcgacctattcaatacattatgcttaaattagcagtttctctggaattcctgtctctcctttaaaagaaaggagagaacattttagaacaatagttctcaaagtgtgttccccggacaagcagcatctgcaacacttaggaaggtcttcgaaatactaatttgtaagccccacctcaggcctactgaatcagaagctctgggggttgggtccagaagtctgttttagtcaaccctctaggtgattctgatgctcgctaaaggttgagaactactgctttagaatgaagtcgtataataaagtctctgaaaaggccttattcagaataagcaagaaaggttctgtgattcacttttgcttctggggctggcaaaaaccttctctgaacccacacaccaagttcgtagttggtaggtgcccagccaagtcctgacatcttcatgccccctctgcagagggcggctgtacgatgttcacatgtctgcgtttggtcagacatcatctccttggctgccctttgaaaccaaatcacttgccttggggataaagtgctcaattggcattagtgagaagcccatcctatcccttgacatacttaatcatatatctctccagagaactcacctgacaaatgtctctgagcacaggctgacaccaaagtggcacaactgcacagttctcagatttctttgcacagattgatttttattgcgggttttgttggggtgtcttaatgttcatctcttttccactgcccatcctctgtgaacccatacctctctagatggagcaggtggccactggtgcctcatactcagtattgaaaaccactacatcccagctacctataatgctgtcagctcaaaatcatagccaggtagttcttgaactcagaacttaaatcctgcacgtggcactccaccactgactggaccgagctggcatatgttgtttctttgtgtttctacatcaaaatgttcgtctaagatttgaactgttctgctgataaccttccccgttgtcatagctatttcattgccaaccaactccatcacatggttgttgatatcgtcatataaagccattgcaaggactctggaaactgccgccaatgaccaatttctgactaaccagccaccttttctctctcttagctccacgtcagcactgagaccagactcgagcacccctgtcctgtaagcgagacaaaatggcgtgtgttattttggggttttgtgttttttggtgggtttctttccttggctctccagatttacttttggggcctgttctaagtgcaaacccagcaagtttcacttgtcctgtccattagatacaactacatcttgcgggggttgtttctttcttgttccacaatgaattgcacatccatctccatcagagctgatagcctgttaataagcactggtctaacacagccaaccctcctccacagcgccatattaatggaggaggggaggaaggtgaaatctactgcatgggattcaggaaacagttgtggttggtcaggacggaagttggggtaagtttggttggtcagagggagttgtgctggagattgtgaaaaatgggttcttgaatgatctactataaggcagggaaggttcatttgtaagtagtaatgtgaactgaattgcattaagagtgtgtggcctttgttgtgatatactatgtattttcttatatgcatgagccaaactgttgcatcataatttagcactgatgtctgcttttattttgatcatctttgtccacccttattagttcttggctgttaaccgtagatagatcttgtaaatccagcaacctttggttgctgcattccccttggttcgattccacgcaaggagccacaagtgagaactccactgtccttagaagaaagggcatttttacttttgaaccaaaaagagaaaaaaaaatcagaagtgttgcatcttgaggcgaattaactgtaagacatttttaattatgactactgcaatttgacaccatttgaaataatcaattcagagacactaaagatttcacaatattcattggtattgtaaaaaaaaaatactattgtatggatttttgtattgctgttaagtattgttttgtgtgtgtgtgtgtgtgtgtgtgttggaacctcctggggacatgttatattttgaagtgattaaactatttaattgtgtgtctatattttggagtggaataatttcttcattaaaaaatgtttttaaaaacactatatcttgggtggtttattcctttgtttcagtgaatctttcctaaagcaacgtggagtcagtctgttgaaagaaggaaggcaggtacttgcagtttaaagcaggacccattgatggaatattgagccaccgaggcaaaatagctcaccttctcttgccttgggggatgcatggtttttaccattctactgttttattagcatctgtgagcatctaatagaaatactattctgctatttatggaaatccttattataattgatatggaagtgagtttgaaattctaacagctaacatatttcatgtttgtatcacacactgttcttaacactttatgtgacttcactcaattctttgaatcctctgcatctagccatgtattctgcaaatattaagtgctcaatggtttttttgttgaattactgaataaatgaattagtggtg

SEQ ID NO: 9097 - DNA, 1787 bp, Homo sapiens
ggaatatcaaggatggtggcagaattaaagggcaaacttaccttccatcccaggtctagtattcagtcccccttcctcccactctccaccctactgcgtgctcttacttattctgttggaacccagtgtagcttcctgagatttaaaatataggaagactcaaaactatgttacttcttggaatatagataattcagtactgatttaaataacaactgaatagcaaggaccttctggaacataatcttacattcacaaaatcacctgctaagaagctgactaatgcattaagcaagtccctgagctgtgcttccagccgtgaacctttgcaccccatgttcccagatcagcctgagaagccactcaacttggctcacatcgtgcctcccagacctgtaaccagcatgaacgacaccctgttctcccactctgttccctcctcaggaagtccttttattaccaggagctctcctcccaaggacagtgaagtagagcagaacaaactgctggctagggctgctccagcttttctgaagggcaaaggcatgcttgagagttcaaaccggcttgatgaagaacacaggctaattgccaggtatgcggcaaggctggcagcagagtcctcttcgtctcagccacctcagcagagaagtgctcctgacatctctttcaccatcgatgcgaataagcagcaaaggcagctgattgctgagctagaaaacaagaacagagaaatcttacaggagatccagagacttcggctagagcatgaacaagcttctcagcccacgccagagaaggcacagcaaaaccccaccctgctggcagaactccggctcctcagacagcgcaaagatgagctggaacagagaatgtctgctctccaggagagccggagagagctaatggtccagttggagggtctcatgaagctactaaagactcagggggcaggctctccccgctcctcccccagccacaccatcagcaggccaattcccatgcccatccggtcagcgtcagcctgctccaccccgacgcacacgccgcaggactccctcacaggagtagggggagatgtacaagaggcatttgcacaaagttcaagaagaaacttaaggaatgacttgctagtggctgcagattccatcactaacactatgtcctctcttgtgaaagagctgaattctgaggttgggagtgaaacagagagtaatgtggattctgaatttgcacggactcagtttgaggatcttgttccctcaccaacctctgaaaaggcttttctagcgcaaatccatgcccgaaaacctgggtacattcacagtggagctaccacaagtaccatgcgtggcgacatggttacggaggatgcagatccctatgtgcagcctgaagatgaaaactatgaaaatgactctgtccggcagctggagaatgagctccagatggaggaatacctgaaacagaagctgcaagatgaagcttatcaggtcagcttgcaaggttgaatgcaatatccttttatcacactcctctcaagcaagctatagtcagacagatgatgaaagtaacatgaaaactggtgatgatggagagccctgtggccacacagaggaggaagacagcagcctggcagcagcctcaccgaagagaggaaccaccacacccagcagctcctgacagacccccacccctaaagatgtgtcctgatgactatagtgcagctaactttttgttctcagatttgtagtgcataggtgtgtgtttcaagaaggaaaaaaaaa

SEQ ID NO: 9098 - DNA, 1680 bp, Homo sapiens; identical to SEQ ID NO: 9076

SEQ ID NO: 9099 - DNA, 2365 bp, Homo sapiens
gggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagaggttacagtatagccaggatatacccagtcacttggccgatgagcatgcgctgatagcctcctatgtggcccgtctgcagcactgtgcacgtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaagctgaggcacgagaatcagctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaagcagaggaaggtgcagaggaagaagaagagaagatgcagaatgggaaagacagaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaag

SEQ ID NO: 9100 - DNA, 822 bp, Homo sapiens
attcaagttgagaattggatggggacacagccaaaccgtatcagggattaatacctgatttctttaatatgaaattgaatattcatgtatattttatgtataagctaactgttcttatgtcctttattacagcctttcattacatttattttctaaattatatttagtaacatgtttatccatataaaacagtagagatatgggaagttacctcaactaatccaggactctgcagagaaaataatcaaagttagaagatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggtt

SEQ ID NO: 9101 - DNA, 565 bp, Homo sapiens
agatcaccccaaatcactgtttcccgaggcgcctaatagcgaacctgtccaggaggtcaccctggacaggaaagaagtgtcccgagacgaggatgccggtgacgaatacttgcccttaaattcctgtgccaggccttgggattaggaagaccttccagctaccgtaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagtta

SEQ ID NO: 9102 - DNA, 2160 bp, Homo sapiens
agcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagaggttacagtatagccaggatatacccagtcacttggccgatgagcatgcgctgatagcctcctatgtggcccgtctgcagcactgtgcacgtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaa

SEQ ID NO: 9103 - DNA, 2384 bp, Homo sapiens
gggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagaggttacagtatagccaggatatacccagtcacttggccgatgagcatgcgctgatagcctcctatgtggcccgtctgcagcactgtgcacgtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaggaagagcaaaagcaggcagctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaagcagaggaaggtgcagaggaagaagaagagaagatgcagaatgggaaagacagaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaa

SEQ ID NO: 9104 - DNA, 2273 bp, Homo sapiens
gggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagagtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaagcagaggaaggtgcagaggaagaagaagagaagatgcagaatgggaaagacagaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaa

SEQ ID NO: 9105 - DNA, 2474 bp, Homo sapiens
gggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagaggttacagtatagccaggatatacccagtcacttggccgatgagcatgcgctgatagcctcctatgtggcccgtctgcagcactgtgcacgtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaggaagagcaaaagcaggcagctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcagcagaggaaggtgcagaggaagaagaagagaagatgcagaatgggaaagacagaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaa

SEQ ID NO: 9106 - DNA, 2294 bp, Homo sapiens
gggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagagtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaggaagagcaaaagcaggcagctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaagcagaggaaggtgcagaggaagaagaagagaagatgcagaatgggaaagacagaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaa

SEQ ID NO: 9107 - DNA, 2275 bp, Homo sapiens
ccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagagtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcagcagaggaaggtgcagaggaagaagaagagaagatgcagaatgggaaagacagaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaa

SEQ ID NO: 9108 - DNA, 2420 bp, Homo sapiens
gggcgcgcgcccgcccatccgccctccgccctccgccctcgcgccctcgcgccgggggcgggcgctgcgcgtgccgggcggagaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagaggttacagtatagccaggatatacccagtcacttggccgatgagcatgcgctgatagcctcctatgtggcccgtctgcagcactgtgcacgtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggaggaagagcaaaagcaggcagctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaa

SEQ ID NO: 9109 - DNA, 2330 bp, Homo sapiens
acaaacacagtaattcctgatactaagaagaggctggggtgccttaagtaatacgcatgcaggcgttgatggggtagagatctgaagtagtcctgccaagaactgggtttacttctttgtgaatgttactactcttacacagaaacctcatatgaattatcatcctctgacttaaggataacagtcagtctgggagacgtttggtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagtgagggccgaggcaagttgacggtattttcagttaaagctatgttagcaaccatgtgtggtggaaaaatgctggacaaattgagatatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagaggttacagtatagccaggatatacccagtcacttggccgatgagcatgcgctgatagcctcctatgtggcccgtctgcagcactgtgcacgtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcaggttagcagaggagccggacacagaggaagctcaggcacagaggacgaggagcaagctggcgccgacatggcgaaggcaaggtcttcccccagaggcacattcctctccatctttccaccgcacacctggaccaggcttgcaggctgccagacgtcactccacccgccagggagaggggagccagagccggtgggaagcggggaggggctgcgtggcacagctagtgggcctccccctgcacagccctgcatgtactagcaccttcatcactcccctcagggcatggtctcatctccgcatcaggaattcacctggaggttgaaaagagaaaagaaaaagcaccaagctcttgtgtgtttgtgacctgatgaaacacttcctggcgtctgg

SEQ ID NO: 9110 - DNA, 1495 bp, Homo sapiens
acccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagatgttttctcccagatgtcagattccaatggcttaatgatatttagcaagtttgaccagtttctgaaggaagttctgaagctcccaacagctgtctttgaagggccatcttttggttacacagagcactcagtccgcacctgttttccacagcagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagaggttacagtatagccaggatatacccagtcacttggccgatgagcatgcgctgatagcctcctatgtggcccgtctgcagcactgtgcacgtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctg

SEQ ID NO: 9111 - DNA, 1857 bp, Homo sapiens
gaagcggcgcgagccgggcgctgcgaacgttcgccgcgggggtggctccggggcctgagtaggcgctgccgctgcctcagccgagggggctgggccggagcgtgcggaggagtgaggccgcaggagaccttcccgacgacccctgctccggcggggaagtgagcaaggatgattgaggaaagtgggaacaagcggaagaccatggcagagaagaggcagctgttcatagaaatgcgtgctcagaattttgatgtcatacgactatcaacttacagaacagcctgcaaattacgatttgtacaaaaacgatgcaaccttcatcttgttgatatctggaacatgattgaagccttccgagacaatggccttaatacactggaccataccaccgagatcagtgtgtcccgcctcgaaactgtcatctcctccatctactatcagttgaacaagcgccttccttctactcaccaaattagtgtggaacaatctatcagcctcctcctcaactttatgattgctgcatatgacagagaaagataatgctaaatatgtttttagacacaatgatggctgaccctcctccccagtgccttgtctggctacctctcatgcacaggcttgcccatgttgagaatgtcttccatcccgtggagtgctcctactgccgatgtgagagtatgatgggtttccggtaccgatgccagcagtgccacaactatcagctctgccagaattgcttttggcgtggccatgccggcggccctcacagcaaccagcaccagatgaaggagcattcctcttggaaatctcctgcaaagaagctgagccatgcaattagtaaatctttggggtgtgtacccacgagagaacccccgcatcctgtttttcctgagcaaccagagaaaccacttgaccttgcacatatagttcctcctcgccctctgactaatatgaatgacaccatggttagccacatgtcctctggagtgcccactcccaccaagaggttacagtatagccaggatatacccagtcacttggccgatgagcatgcgctgatagcctcctatgtggcccgtctgcagcactgtgcacgtgttctggacagtcctagccgactggatgaggaacaccgtcttatagctcgctatgctgcccggctggctgcagaagcaggaaacgtgactcgtcctcccactgacttgagctttaactttgatgccaacaaacaacaaagacagcttattgcagaactggaaaacaaaaacagagagatcctgcaggagattcagcgtctccgcctggaacacgagcaggcctcccagcccacccctgagaaggcacagcagaaccccacgctgctggcagagctgcggctgctgaggcaaaggaaggatgaactggagcagaggatgtcggccctgcaggagagcaggcgggagctgatggtccagctggaagagctgatgaagttgctgaaggctcaggccacagggtcaccacatacatcgcccacccatggaggcggccggccaatgcccatgccagtgcgctccacgtctgccggctccacccccacccactgtccgcaggactcgctgagcggagtcgggggagacgtgcaggaggccttcgcacaaggtacgaggagaaacctccgcaatgacctgctggtggcagctgactccatcaccaacaccatgtcatccctggtgaaggagctccattcagcagaggaaggtgcagaggaagaagaagagaagatgcagaatgggaaagacagaggttagcagaggagccggacacagaggaagctcaggcacagaggacgaggagcaagctggcgccgacatggcg

SEQ ID NO: 9112 - DNA, 5518 bp, Homo sapiens
aggcagaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctgggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaattcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggtcgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttatt

SEQ ID NO: 9113 - DNA, 432 bp, Homo sapiens
atgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccccgccctctctggtcctcccaaaccccaaagcagctggagagactttggggacttttttatttttattttttgcctaacagcttttggtttgttcatagagaattcttcgcttcatttttga

SEQ ID NO: 9114 - DNA, 731 bp, Homo sapiens
agaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctggggccactgctctccaggaagataaggcttttaaagcagcctagcactagaaggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcct

SEQ ID NO: 9115 - DNA, 562 bp, Homo sapiens
cttaggcttggcggtggcggcggcggcagcttcgcgccgaatccccggggagcggcggtggcggcgtcctggggccaggaggagcgaacacctgccgcggtcctcccgccggcgctgggcacacgactgtctatcccagatggctgcactggcctaggacagacggttcttcccccagtacgtcaagaccctggagggtgcaagctacagaacagctgggctcctgcattcctcccagaccctgtcttcagtaggacaacaggcaacaaacttaaatttgggattctcattctgtctcccatgctggagtgcagtggcgcggtcttggctcactgaaacctttgcttcccagggtcaagcgattcccctgcctcagcttcctgagtagctgggattacaggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcgggga

SEQ ID NO: 9116 - DNA, 579 bp, Homo sapiens
aggcagaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttg

SEQ ID NO: 9117 - DNA, 841 bp, Homo sapiens
cgcggcgctcgcgcctcttaggcttggcggtggcggcggcggcagcttcgcgccgaatccccggggagcggcggtggcggcgtcctggggccaggaggagcgaacacctgccgcggtcctcccgccggcgctggacctggttcacctgcgagtgtatttggatagtgtctccacagaaaatgtcgtctcggcttggaatctttttgccataaattctaaggccactgctctccaggaagataaggcttttaaagcagcctagcactagaaggtgaggcacacgactgtctatcccagatggctgcactggcctaggacagacggttcttcccccagtacgtcaagaccctggagggtgcaagctacagaacagctgggctcctgcattcctcccagaccctgtcttcagtaggacaacaggcaacaaacttaaatttggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggt

SEQ ID NO: 9118 - DNA, 397 bp, Homo sapiens
aggcttggcggtggcggcggcggcagcttcgcgccgaatccccggggagcggcggtggcggcgtcctggggccaggaggagcgaacacctgccgcggtcctcccgccggcgctgggtgagtgcaccgcccgccctatccgctgtgcctggctgcttgggcccccatccctgctgccggctgagccttccgcggaacacctgctgctgctcgctgttcggcccggggcggggacacggccgcggacgtccttgtgggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgct

SEQ ID NO: 9119 - DNA, 549 bp, Homo sapiens
cttgcgctcagcgccctctcaccgcccgggccactgctctccaggaagataaggcttttaaagcagcctagcactagaaggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctgga

SEQ ID NO: 9120 - DNA, 624 bp, Homo sapiens
acgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctggggattctcattctgtctcccatgctggagtgcagtggcgcggtcttggctcactgaaacctttgcttcccagggtcaagcgattcccctgcctcagcttcctgagtagctgggattacaggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctca

SEQ ID NO: 9121 - DNA, 588 bp, Homo sapiens
gtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctggggccactgctctccaggaagataaggcttttaaagcagcctagcactagaaggtgaggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgat

SEQ ID NO: 9122 - DNA, 547 bp, Homo sapiens
acgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctggatagccctgggatctcctgaatttccaggttgggctactcaggcatggattgactcctacagttcaggcggatggagatcccaccaacccacagcttaattcttcagatgctttatcttcatttctcatgtatcttcagttggcttctaatgctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggac

SEQ ID NO: 9123 - DNA, 5563 bp, Homo sapiens
ttttagtagagacggggtttcacgttgttggtcaggctggtctcaaactcctgacctcaggtgatccacccgccttggcctcccaaagtgctgggattacaggtgtgagccaccgcggctggtcaaaattttttttttttggtactttttttgcagaggcggggtttcgacacgttgcccaggctggtcttgaactcctgagctcaagctatccatccacctgcctcggcctcccatagtgctgggactacaggcgggagcacagcacctagccccttccttttcttgtctctgtgaatgaggtttggagccgagacactgaagtatagataattgcaaaaaggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaattcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggtcgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattacaa

SEQ ID NO: 9124 - DNA, 5579 bp, Homo sapiens
aggcagaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctggggccactgctctccaggaagataaggcttttaaagcagcctagcactagaaggtgaggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaattcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggtcgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattacaa

SEQ ID NO: 9125 - DNA, 5662 bp, Homo sapiens
aggcagaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctgggtgagtgcaccgcccgccctatccgctgtgcctggctgcttgggcccccatccctgctgccggctgagccttccgcggaacacctgctgctgctcgctgttcggcccggggcggggacacggccgcggacgtccttgtgggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaattcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggtcgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattacaa

SEQ ID NO: 9126 - DNA, 5673 bp, Homo sapiens
aggcagaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctggatagccctgggatctcctgaatttccaggttgggctactcaggcatggattgactcctacagttcaggcggatggagatcccaccaacccacagcttaattcttcagatgctttatcttcatttctcatgtatcttcagttggcttctaatgctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaattcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggtcgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattacaa

SEQ ID NO: 9127 - DNA, 5826 bp, Homo sapiens
aggcagaagccggcggcgcgcggacagccagtcggcgccgcgcggagctggccgctggattggctgcaacactcgcgtgtcaggcggttgctaggctccggccgcgcgccccgcccttgcgctcagcgccctctcaccgcccggtacgtgctcgcgcgaaggctgcggcgcggcgctcgcgcctcttaggcttggcggtggcggcggcggcagcttcgcgccgaatccccggggagcggcggtggcggcgtcctggggccaggaggagcgaacacctgccgcggtcctcccgccggcgctggacctggttcacctgcgagtgtatttggatagtgtctccacagaaaatgtcgtctcggcttggaatctttttgccataaattctaaggccactgctctccaggaagataaggcttttaaagcagcctagcactagaaggtgaggcacacgactgtctatcccagatggctgcactggcctaggacagacggttcttcccccagtacgtcaagaccctggagggtgcaagctacagaacagctgggctcctgcattcctcccagaccctgtcttcagtaggacaacaggcaacaaacttaaatttggctctgtgtgctccgggatggagcaggtgtgcagagggtgagaacccagctctgggaccaagtcacttgcttccttacttagcaagactatcgacttgagcaaacttggacctgggatgaggatgtctgtgggcctctcgctgctgctgcccctctcggggaggacctttctcctcctgctctctgtggttatggctcagtcccactggcccagtgaaccctcagaggctgtcagggactgggaaaaccagcttgaggcatccatgcactcagtgctctcagacctccacgaggctgttcccacagtggttggcattcctgatggcacggctgtcgtcgggcgctcatttcgagtgaccattccaacagatttgattgcctccagtggagatatcatcaaggtatcagcggcagggaaggaggctttgccatcttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaattcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggtcgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttattacaa

SEQ ID NO: 9128 - DNA, 3271 bp, Homo sapiens
ggggcgcccaagatggcggcgggcggcgcggagggcggctcgggccccggcgccgccatgggggactgcgcggagattaagtcgcaattccgcacgcgcgagggtttctacaagctactcccgggcgacggcgccgctcgcaggtcgggtccggcttccgcccagactccggtgccgcctcagccaccgcagcccccgcccggccctgcctccgcctccggtcccggcgctgcaggccccgcgtcgtccccgccgcccgcaggccccggacccgggcccgccctgcccgccgtgcgcctcagcctcgtgcgcctcggggagccggacagcgccggggccggggagccgcccgccacgcccgcggggctgggctcggggggagaccgcgtctgcttcaacttgggccgtgagctctatttctacccaggctgctgtcgtcgtgggagccaacggtccattgacctcaacaagccaattgacaagcggatctacaagggcacccagcccacctgccacgatttcaaccagttcactgctgccaccgagaccatctcgctgctggtgggcttctcagcgggtcaagtgcagtacctggatctcatcaaaaaggacaccagcaagctgttcaatgaggagcggttgatcgacaagaccaaggtgacatatctgaagtggctgcctgagtcggagagcctgttcctggcatcacacgccagtggccacctgtacctgtacaacgtcagccacccctgcgcctcggccccgccccagtacagcctgctgaagcagggcgagggcttctctgtctatgctgccaagagcaaggcaccccgcaacccgctggccaagtgggcggtgggtgaggggcccctcaacgagttcgccttctcgcccgatggccggcacctggcctgtgtgagccaggatggctgcctgcgcgtcttccacttcgactccatgctcctgcgtgggctcatgaagagctactttgggggcctgctgtgtgtgtgctggagccctgacggccgctacgtggtgacgggtggcgaagatgacctggtcaccgtgtggtccttcaccgagggccgcgtggtggctcgaggccatggccacaagtcctgggtcaacgctgtggcctttgacccctacaccacaagggcagaggaggcggcgacagcagccggtgctgatggggagcggagcggcgaagaggaggaggaggagcccgaggctgcgggcacaggctcggccgggggcgccccgctctctccactgcccaaggctggctccattacttaccgctttggctcggcgggccaggacacgcagttctgcctgtgggacctcactgaagacgtgctctacccgcacccccccctggcccgcacccgcaccctccctggcacacctggcaccacgccaccggccgccagcagctcgaggggtggcgagcctggcccaggccccctgcctcgctcgctgtcccgctccaacagtctcccgcacccagctggcgggggcaaggcgggcggcccgggtgtggcggcagagcctggcacaccattcagcattggccgcttcgccacgctcacactgcaggagcggcgggaccggggggcagagaaggagcacaagcgctaccacagcctgggcaacatcagccggggtggcagtggcggcagtggcagtggtggggagaagcccagcggccctgttccccgcagccgcctggaccccgccaaggtgctgggcactgcgctgtgcccgcgcatccacgaggtgcccctgctggagccccttgtgtgcaagaagatcgcccaggagcggctcacagtcctcctgttcctggaggactgcatcatcactgcctgccaggagggcctcatctgcacctgggcccggccgggcaaggcgttcacagacgaggagaccgaggcccagacaggggaaggaagttggcccaggtcacccagcaagtcagtggtagagggcatctcctcccaaccaggcaactccccgagtggcacagtggtgtgaagccatggatatcgggcccccccaaccccatgcccccagcctcctagccataaccctccctgctgacctcacagatcaacgtattaacaagactaaccatgatggatggactgctccagtccccccacctgcacaaaatttgggggccccccagactggcccggacacgggcgatgtaatagcccttgtggcctcagccttgtcccccacccactgccaagtacaatgacctcttcctctgaaacatcagtgttaccctcatccctgtccccagcatgtgactggtcactcctggggagagactccccgcccctgccacaagagccccaggtctgcagtgtgcccctcagttgagtgggcagggccgggggtggtccagccctcgcccggcccccaccccagctgcccttgctattgtctgtgcttttgaagagtgttaaattatggaagcccctcaggttcctccctgtcccgcaggacctcttatttatactaaagttccctgttttctcagcgggtctgtccccttcggaggagatgatgtagaggacctgtgtgtgtactctgtggttctaggcagtccgctttccccagaggaggagtgcaggcctgctcccagcccagcgcctcccaccccttttcatagcaggaaaagccggagcccagggagggaacggacctgcgagtcacacaactggtgacccacaccagcggctggagcaggaccctcttggggagaagagcatcctgcccgcagccagggcccctcatcaaagtcctcggtgttttttaaattatcagaactgcccaggaccacgtttcccaggccctgcccagctgggactcctcggtccttgcctcctagtttctcaggcctggccctctcaaggcccaggcaccccaggccggttggaggccccgacttccactctggagaaccgtccaccctggaaagaagagctcagattcctcttggctctcggagccgcagggagtgtgtcttcccgcgccaccctccaccccccgaaatgtttctgtttctaatcccagcctgggcaggaatgtggctccccggccaggggccaaggagctattttggggtctcgtttgcccagggagggcttggctccaccactttcctcccccagcctttgggcagcaggtcacccctgttcaggctctgagggtgccccctcctggtcctgtcctcaccaccccttccccacctcctggg

SEQ ID NO: 9129 - DNA, 2863 bp, Homo sapiens
aggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgctgctgctgctgctgctgctgctgctgctgctgctgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgccc

SEQ ID NO: 9130 - DNA, 2872 bp, Homo sapiens
ggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggccccaaatccagggttttccaaagtgtggttcaagaaccacctgcatctgaatctagagcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgccc

SEQ ID NO: 9131 - DNA, 3232 bp, Homo sapiens
gccacaagcctccaccccagctggtcccccacccaggctgcccagtttaacattcctagtcataggaccttgacttctgagaggcctgattgtcatctgtaaataaggggtaggactaaagcactcctcctggaggactgagagatgggctggaccggagcacttgagtctgggatatgtgaccatgctacctttgtctccctgtcctgttccttcccccagccccaaatccagggttttccaaagtgtggttcaagaaccacctgcatctgaatctagaggtactggatacaaccccacgtctgggccgttacccaggacattctacatgagaacgtgggggtggggccctggctgcacctgaactgtcacctggagtcagggtggaaggtggaagaactgggtcttatttccttctccccttgttctttagggtctgtccttctgcagactccgttaccccaccctaaccatcctgcacacccttggagccctctgggccaatgccctgtcccgcaaagggcttctcaggcatctcacctctatgggagggcatttttggcccccagaaccttacacggtgtttatgtggggaagcccctgggaagcagacagtcctagggtgaagctgagaggcagagagaaggggagacagacagagggtggggctttcccccttgtctccagtgccctttctggtgaccctcggttcttttcccccaccacccccccagcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgctgctgctgctgctgctgctgctgctgctgctgctgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgccc

SEQ ID NO: 9132 - DNA, 2550 bp, Homo sapiens
atgggagggcatttttggcccccagaaccttacacggtgtttatgtggggaagcccctgggaagcagacagtcctagggtgaagctgagaggcagagagaaggggagacagacagagggtggggctttcccccttgtctccagtgccctttctggtgaccctcggttcttttcccccaccacccccccagcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggtgagcgggggcggggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatgtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgccc

SEQ ID NO: 9133 - DNA, 1982 bp, Homo sapiens
gagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacaggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgt

SEQ ID NO: 9134 - DNA, 2712 bp, Homo sapiens
gggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccgtggctgtgggccagtgcccgctggtggggccagatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgccc

SEQ ID NO: 9135 - DNA, 2848 bp, Homo sapiens
aggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgctgctgctgctgctgctgctgctgctgctgctgctgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgccc

SEQ ID NO: 9136 - DNA, 2844 bp, Homo sapiens
aggggggctggaccaaggggtggggagaaggggaggaggcctcggccggccgcagagagaagtggccagagaggcccaggggacagccagggacaggcagacatgcagccagggctccagggcctggacaggggctgccaggccctgtgacaggaggaccccgagcccccggcccggggaggggccatggtgctgcctgtccaacatgtcagccgaggtgcggctgaggcggctccagcagctggtgttggacccgggcttcctggggctggagcccctgctcgaccttctcctgggcgtccaccaggagctgggcgcctccgaactggcccaggacaagtacgtggccgacttcttgcagtgggcggagcccatcgtggtgaggcttaaggaggtccgactgcagagggacgacttcgagattctgaaggtgatcggacgcggggcgttcagcgaggtagcggtagtgaagatgaagcagacgggccaggtgtatgccatgaagatcatgaacaagtgggacatgctgaagaggggcgaggtgtcgtgcttccgtgaggagagggacgtgttggtgaatggggaccggcggtggatcacgcagctgcacttcgccttccaggatgagaactacctgtacctggtcatggagtattacgtgggcggggacctgctgacactgctgagcaagtttggggagcggattccggccgagatggcgcgcttctacctggcggagattgtcatggccatagactcggtgcaccggcttggctacgtgcacagggacatcaaacccgacaacatcctgctggaccgctgtggccacatccgcctggccgacttcggctcttgcctcaagctgcgggcagatggaacggtgcggtcgctggtggctgtgggcaccccagactacctgtcccccgagatcctgcaggctgtgggcggtgggcctgggacaggcagctacgggcccgagtgtgactggtgggcgctgggtgtattcgcctatgaaatgttctatgggcagacgcccttctacgcggattccacggcggagacctatggcaagatcgtccactacaaggagcacctctctctgccgctggtggacgaaggggtccctgaggaggctcgagacttcattcagcggttgctgtgtcccccggagacacggctgggccggggtggagcaggcgacttccggacacatcccttcttctttggcctcgactgggatggtctccgggacagcgtgcccccctttacaccggatttcgaaggtgccaccgacacatgcaacttcgacttggtggaggacgggctcactgccatggagacactgtcggacattcgggaaggtgcgccgctaggggtccacctgccttttgtgggctactcctactcctgcatggccctcagggacagtgaggtcccaggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctgtcacgggggtccccagtccccgggccacggatccaccttcccatatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaaccctagaactgtcttcgactccggggccccgttggaagactgagtgcccggggcacggcacagaagccgcgcccaccgcctgccagttcacaaccgctccgagcgtgggtctccgcccagctccagtcctgtgatccgggcccgccccctagcggccggggagggaggggccgggtccgcggccggcgaacggggctcgaagggtccttgtagccgggaatgctgctgctgctgctgctgctgctgctgctgctgctgctgctgctgctgctgctgctgctggggggatcacagaccatttctttctttcggccaggctgaggccctgacgtggatgggcaaactgcaggcctgggaaggcagcaagccgggccgtccgtgttccatcctccacgcacccccacctatcgttggttcgcaaagtgcaaagctttcttgtgcatgacgccctgctctggggagcgtctggcgcgatctctgcctgcttactcgggaaatttgcttttgccaaacccgctttttcggggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgccc

SEQ ID NO: 9137 - DNA, 599 bp, Homo sapiens
aggccccacacccatggaactggaggccgagcagctgcttgagccacacgtgcaagcgcccagcctggagccctcggtgtccccacaggatgaaacagctgaagtggcagttccagcggctgtccctgcggcagaggctgaggccgaggtgacgctgcgggagctccaggaagccctggaggaggaggtgctcacccggcagagcctgagccgggagatggaggccatccgcacggacaaccagaacttcgccagtcaactacgcgaggcagaggctcggaaccgggacctagaggcacacgtccggcagttgcaggagcggatggagttgctgcaggcagagggagccacagctagatggccccccggccgtggctgtgggccagtgcccgctggtggggccaggccccatgcaccgccgccacctgctgctccctgccagggtccctaggcctggcctatcggaggcgctttccctgctcctgttcgccgttgttctgtctcgtgccgccgccctgggctgcattgggttggtggcccacgccggccaactcaccgcagtctggcgccgcccaggagccgcccgcgctccctgaacc

SEQ ID NO: 9138 - DNA, 7048 bp, Homo sapiens
acactagcaatggcaaagctttgtgcggaggcattgctggctgctctgaactaaaagcatccgtggggaccgaaagaggtttttgcacaccttattaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 9139 - DNA, 13956 bp, Homo sapiens
gggatcactcactttccccctacaggactcagatctgggaggcaattaccttcggagaaaaacgaataggaaaaactgaagtgttactttttttaaagctgctgaagtttgttggtttctcattgtttttaagcctactggagcaataaagtttgaagaacttttaccaggttttttttatcgctgccttgatatacacttttcaaaatgctttggtgggaagaagtagaggactgttatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcagatcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 9140 - DNA, 7339 bp, Homo sapiens
acactagcaatggcaaagctttgtgcggaggcattgctggctgctctgaactaaaagcatccgtggggaccgaaagaggtttttgcacaccttattaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 9141 - DNA, 2224 bp, Homo sapiens
actttcggggagcccggcggctctgggaagctcactcctccactcgtacccacactcgaccgcggagcccttgcagccatgagggaacagctcaaaggccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggt

SEQ ID NO: 9142 - DNA, 13932 bp, Homo sapiens
gtgcaaaaagattgtgtgtttgtctgcttttgtgaggctggtcagagattctgtgcctgctttatctgtgcttggctatgactctacctccaggtttaccataccccatagaatgtgtaagagaaaagtaccaacagggaaatcagcaaaaagctttcctatgaaggtgtgtagccagcctccgcagaatttgaaatgtctgaggtctcatctgatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcagatcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 9143 - DNA, 7032 bp, Homo sapiens
atgactgagatgattttgctaattttttttccagcctatttccttaatgctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacaccccc

SEQ ID NO: 9144 - DNA, 7023 bp, Homo sapiens
atgagtgccaggaagctgcgaaatctgtcttacaaaaaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacaccccc

SEQ ID NO: 9145 - DNA, 2617 bp, Homo sapiens
cacactcgaccgcggagcccttgcagccatgagggaacagctcaaaggccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaattt

SEQ ID NO: 9146 - DNA, 7410 bp, Homo sapiens
acactagcaatggcaaagctttgtgcggaggcattgctggctgctctgaactaaaagcatccgtggggaccgaaagaggtttttgcacaccttattaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 9147 - DNA, 4645 bp, Homo sapiens
agtgctttcagctgtgagcttgggcggcggcggcggcggcgctccactttcggggagcccggcggctctgggaagctcactcctccactcgtacccacactcgaccgcggagcccttgcagccatgagggaacagctcaaaggccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagta

SEQ ID NO: 9148 - DNA, 5209 bp, Homo sapiens
acactagcaatggcaaagctttgtgcggaggcattgctggctgctctgaactaaaagcatccgtggggaccgaaagaggtttttgcacaccttattaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatc

SEQ ID NO: 9149 - DNA, 11031 bp, Homo sapiens
attttagatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcagatcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacaccccc

SEQ ID NO: 9150 - DNA, 14083 bp, Homo sapiens
tgctgtctgtgaagctgaatctgtgagaacacctcactattcacggcaaccggagtggaagaaacaggtgcaaaaagattgtgtgtttgtctgcttttgtgaggctggtcagagattctgtgcctgctttatctgtgcttggctatgactctacctccaggtttaccataccccatagaatgtgtaagagaaaagtaccaacagggaaatcagcaaaaagctttcctatgaaggtgtgtagccagcctccgcagaatttgaaatgtctgaggtctcatctggtgagtaaaagctgcagataaatgcaacagccattcagaagaatgataaattccacaagcattcagaagcaggcttccctaaagatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcagatcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttatagctcttaaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 9151 - DNA, 7080 bp, Homo sapiens
acactagcaatggcaaagctttgtgcggaggcattgctggctgctctgaactaaaagcatccgtggggaccgaaagaggtttttgcacaccttattaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 9152 - DNA, 13993 bp, Homo sapiens
tcctggcatcagttactgtgttgactcactcagtgttgggatcactcactttccccctacaggactcagatctgggaggcaattaccttcggagaaaaacgaataggaaaaactgaagtgttactttttttaaagctgctgaagtttgttggtttctcattgtttttaagcctactggagcaataaagtttgaagaacttttaccaggttttttttatcgctgccttgatatacacttttcaaaatgctttggtgggaagaagtagaggactgttatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcagatcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttatagctcttaaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 9153 - DNA, 7277 bp, Homo sapiens
cgctttcctcctctgcttctaatgaattgacatctccaagagccgccacatctctggtagttttacaaaactgtccttgctcttcctgcgtttgcccagtcaagggtatttttgcctgaggtcggaatgatgctgttagtcctggtgatatgattgcatagcaacacagagcagctctgagaggggaggaggaggagaagaaggaagacagggaagtgggagagacagagggagagtgtgcatacagcagctgtcggcatccctgtctcagggacttctttgctgattcacagaggcagcccagccccggcctcccagcttacagctgccgcctgcttctcagacctgacggaatcagaagctacataatattcgccgtgtgagtggctatcgtaatagataacatttgaatatctactaaatgccagaaactatgaattaactcctctcaacaaagctaagaggtgcttaatgatcaatagttggtgcactgcctatcctcatcccccccatgagccttggtttttatgcaacctatggtcatgcagggatgcccttacaccctcccacgatgtcatgactggcaggcagctgaccagttccatcatagcagcagcctccgaagcacctgcccccaccctcaggttagagctgctgtcaccagccctgcacctcctcaagatggtgctggggttccctgcctaagcctaaagctgttgaacgggtctgttggtgcctctggacccctggaaccaccagccatgaatctgtgttggaatgaaataaaaaagaagtctcacaacctccgcgctcgcctagaggccttctcagaccacagtggaaagcttcagctccctcttcaagagattattgactggctcagccaaaaggatgaggagttgtcagctcagctgcccctacagggggatgtggccctggtgcaacaggagaaggagacacatgcggcctttatggaagaagtcaagtctcggggcccctacatctattctgtgctggagtcagctcaggccttcctgtcccagcacccatttgaggagttagaggagcctcattctgagagcaaagatacctccccgaaacagcggatccagaatctcagccgctttgtatggaagcaggcgacggtggccagtgaactgtgggagaagttgacagcccgctgtgtggaccagcaccgtcacattgagcggactctggagcagctcttggagattcaaggggcaatggaggaactaagcactactctgagccaagctgagggagtccgagccacttgggagcccattggggatctcttcattgattcactcccagagcacatccaggctattaagctgttcaaagaagaattctcccccatgaaagatggagtaaagttggtgaatgatctggcccaccaacttgccatttctgatgtgcacttgtcaatggagaattcccaggccctggaacagatcaacgtccgatggaaacaactacaggcgtcagttagtgagaggcttaagcagctccaggatgcccaccgggactttgggcctgggtcacagcactttctctcctcctctgtccaggttccctgggaaagagcaatttcacccaataaagttccctactacatcaaccaccaggctcagaccacatgctgggaccatcccaagatgacagagttataccaaaccctagctgatctgaacaacattaagttctcagcttatcgcactgccatgaaactccgcagagtccagaaagccctgcgcttggacctggtaactttaaccacagccctggaaatcttcaatgagcatgatctgcaggccagtgagcacgtgatggatgtggtagaggtcattcactgcctgactgccttatatgaacgtttggaggaggaaagaggcatcctggtcaacgtgccactctgtgtggacatgagcctcaattggctcctcaatgtttttgatagtggtcgcagcggaaagatgcgggcattgtcttttaagactggcattgcatgcttgtgtggcacggaagtgaaggaaaaacttcagtacctcttcagccaagtggccaactcaggcagccagtgtgaccagcgccaccttggtgtcctgcttcatgaggccattcaggtgccccgtcagctgggtgaagtggcagcctttgggggcagcaatgtggagcccagtgtccgtagttgcttccgttttagcaccgggaagccagtcattgaagcatcccagttcctggagtgggtcaacctggagccccagtccatggtgtggctggctgttctgcatcgggtcaccattgctgagcaagtgaagcatcagaccaagtgctctatctgtaggcagtgccccatcaaggggttcaggtaccggagtctgaagcaattcaacgttgacatctgccagacctgcttcttgacaggcagggccagcaaaggcaataagctgcactaccccatcatggagtattacacaccgaccacatccagtgagaacatgagggactttgccacaaccttaaagaacaaattccgctccaagcattatttcagcaaacaccctcagcgaggttatctgcctgtgcaatcagtgctggaggctgactacagtgagacgccggcttcttccccgatgtggccacacgccgacacacactcccgaattgagcattttgccagcaggcttgctgagatggaaagtcaaaattgctccttctttaatgacagcttgtccccagatgacagcatagacgaggaccagtacctgctgcggcactccagccccatcacagaccgggagccagcctttggacagcaggctccatgcagtgtggccacagaaagcaaaggggagctacagaagatcctggcccacttggaagatgagaaccggattctccagggagagctgaggcgcctgaagtggcagcatgaggaggcagctgaggcacccagtctggctgacggctccactgaggcagcaacagaccaccgcaatgaggagcttctggccgaggcccgtatccttcggcaacataagagccgcctggagacgcgcatgcagatcctcgaagatcacaacaagcagctagagtcccagctgcagcgtctgagggagcttctcctgcagccacccaccgaatcagatggcagtggctctgcaggctcgtccctagcttcctctccacagcagtcagaaggcagtcacccccgggagaagggacagactactccagataccgaggctgcagatgatgtggggtcaaagagccaggatgtcagcctgtgcttggaggacatcatggagaaactccgtcatgccttccccagtgtgcgaagttctgatgtgactgccaacaccctgctggcctcttgatggagccagatccccatcctatagttcatagtcctctcctggttccggtcaaagcctttcctcagccttcacccaacctttccagtttccactggccccacattcctcaactagtattatttgggctctgggcagcagcagggatctggtggtatgtgaggtgcatgcgggcagtgatgggagaaggggaggcatgattcttctgaccctagaaatgttccctttaatcttcaagttcgagatcagccctttaagtacctttctgttgcagcccaggcaaatatcacttggccattcagatggggagcagagaagctgccttgcagagctaagcggtacatgttggcccctcttccttctccgtggaattatggaaagagagaagcctaattaccccaaggttccatccagcattatgaatccacagggtttacccctactctctggcgcaactcagggaggcaaaagggtatccccgagacaccttccccaccccaagtgcccctgaaaaagtctgggcagtgtgtgttctattacttcagctccaggacagattgctagccatcctaatgctacctaggtattggtttctcctcaaatatcttcattttctttagcctcagtccctgacagaccttccttaaggggagaacagttcattctggttcttctacgttatatttggaagcattaaatccatacttatgggtttagattttttttttgccccacatcttcctatttcttaaagtcctcagcattttgagagacccactgagttgcgagttgctctggaaacctggctgaagccaccctttgctcctctgagtctgtcctcacagacctgaggacacagtggcagcttgctgagcaagggagtgttgctttccttgggtaaggaagaggaagcccacctcaagtctggagtagtatgactgccatccaacacccttccaggctgtgacccttctagctctcaggctgaatcaggtgaggtggctgattgtccccagctaatcataaggcatttgcaactggctaccgtgtgtagtggcccctccataggagccacaggccacaaatcaggaagctggccactttccacccagacaacaacagcaaggccttcctgtgcctaaaattgttatttctaactctggaaggtgaatccaatcctcaaactgaactagctcttcctaggcgacatataccatgatctctttatccagaaactgttcagaatagatagtaggggtgggggagtgggcttgggaatgttgaatagattcagagcccacttaggcagctttctcccaagaggagctttataacctagagccctgcagttgacttcatttgcctaagtttatatacatacatatctattctacatatctactgtacatcagtgctctcctggcctcactcacacattaaattctaatacctcttgaagtattaatgttctgccttgctctttgttagccccagcctctggttggaaagatagatgtatcctggctgttcccctaggatatctctctccattgatgtttggggtgggctgtcctcaagaccaaagcaacagaaacctgtggtcacagagaatctaacaggaagagtcactgttctcttcactcattccaaatcttgttcccttgagacctgggccttgggtgaattttcctgggctcccctaaatggttcaggtgccaaaatagagcaaacccaagctctgcccaccccatgcagaaaaggacaaacaggcctttattagcctttgccagctaagacacagagaacattctctggtcccttccagctcttatggtctcactcagggctaaagaaagcaacagttgccaccacaatcaggagggagtgacggttggggtgttgtattataatccagcagtgggccagtgggtagaactgctaggaacctagtttgatctgctgcaggggaggcagggcagtggcttgggtccagaagcttagggttgcctcctccaccactaagtcacaggtccagggtgtcagacttcacagcataacatctgccttagtgttcatgaggtctctgggcaggagaactgggtatctggatagatggttgagcaggtggtaggcgggcatcaatcatagaacctgggcatcagtcagagtgggagcatatttgtagaagcctagattgtgggcgggaatgtgggacggagggctcaaggactttggaggcatatgcctgcctaagccttaggcgggtacatgttatggagcaattttttaccaggaaagtcctggaaaatcttttctgttatccccaccccacctgagagctcttgggctgctgagggcctgtggcaactgcagtgggccaggcatggtagaaaagatgtagatcttgttatgtaggatttgcgttgtaggtggactgaagcagcaggtcaagagttgaattctcactaaggggtcactgacattttgtggtcctgtgtttaccttaatgcctaaggtgagtgtattgttcaagggtccagggacagtcactgcagtatgtgtggggaattttcccacagtaaggtaaatggatccttgggtactatgaatccaacttggggttggatttaccaaaatgtgttgtatgttgttagacatcttgttgtgtattagtcttctaaggatattgtgcatggcactgtgtagtttatagccctacactggaaggatggtgaagggagttgctagattgatagcctaaagaaaaccttctgactgtgggattagcatcaatgataaggaatgtgagcatttgctggggttgttgtcaaatagtatcagagaacagttaggactgagaggtgatttcttcttgacagaatttgatagaggccaaaaagccattacgaggatacctctgcttccagtgacagcagagtggattcacattgattgggcattgtcacggaaggctgactagctggaggacatcaggctgtgctatgcttccctagggaggacatgtgcccttccctccagattagaaaggctagaatcaagagtttcaagtgctcattttcttcaaggtccaaggttgggaactatttccctacagagaaatctgtttgagtttctggtgctccaggaaatgggttggcaggacacagaaatgagaaaccctgaggccaggaagaggccaatcctaggagatgttttccctccagattcattttaaggaatatctgtgcttcctgatgtgtgtgcttgagatttgggctctatatccagcatttgaactcacattctcagtggcagagtcatggtctgtggcaccatttcaaggccaaaaatcccatccaatttcccttcacatagatgacagaaaagcaagaaagtagctgccttaactcgaacagttctgggaaaaaaactgggggccttgtcctgaggctgtggagacttaattcttcagctgggtggttcccgtaggaacaaggaacactttagctacttcttactcttttaacaccaatggctgtgggagaaggaaaggctcaaggccagggctcagctcgcagagtccatcttctcccacagttgccacatttgagagggggcctgctgaatgcccttgctgtcccctatggcagtattgaggcctgaccgaagtctggtatgctgcttgctggctacaagaactggtcacaggatgaaaattggggaaaggatttgggggaggtgacaagggtggcatggaagtctaggggacaaagggacagggttgggaacaaattggttaactttgattgccactcactgtggtgctttccccctttcccttgaattctgctttgaaaagaataaatttgtacttgttta

SEQ ID NO: 9154 - DNA, 7018 bp, Homo sapiens
tgcttctcaggctcttccgctttcctcctctgcttctaatgaattgacatctccaagagccgccacatctctggtagttttacaaaactgtccttgctcttcctgcgtttgcccagtcaagggtatttttgcctgagaggcagcccagccccggcctcccagcttacagctgccgcctgcttctcagacctgacggaatcagaaggtgcttaatgatcaatagttggtgcactgcctatcctcatcccccccatgagccttggtttttatgcaacctatggtcatgcagggatgcccttacaccctcccacgatgtcatgactggcaggcagctgaccagttccatcatagcagcagcctccgaagcacctgcccccaccctcaggttagagctgctgtcaccagccctgcacctcctcaagatggtgctggggttccctgcctaagcctaaagctgttgaacgggtctgttggtgcctctggacccctggaaccaccagccatgaatctgtgttggaatgaaataaaaaagaagtctcacaacctccgcgctcgcctagaggccttctcagaccacagtggaaagcttcagctccctcttcaagagattattgactggctcagccaaaaggatgaggagttgtcagctcagctgcccctacagggggatgtggccctggtgcaacaggagaaggagacacatgcggcctttatggaagaagtcaagtctcggggcccctacatctattctgtgctggagtcagctcaggccttcctgtcccagcacccatttgaggagttagaggagcctcattctgagagcaaagatacctccccgaaacagcggatccagaatctcagccgctttgtatggaagcaggcgacggtggccagtgaactgtgggagaagttgacagcccgctgtgtggaccagcaccgtcacattgagcggactctggagcagctcttggagattcaaggggcaatggaggaactaagcactactctgagccaagctgagggagtccgagccacttgggagcccattggggatctcttcattgattcactcccagagcacatccaggctattaagctgttcaaagaagaattctcccccatgaaagatggagtaaagttggtgaatgatctggcccaccaacttgccatttctgatgtgcacttgtcaatggagaattcccaggccctggaacagatcaacgtccgatggaaacaactacaggcgtcagttagtgagaggcttaagcagctccaggatgcccaccgggactttgggcctgggtcacagcactttctctcctcctctgtccaggttccctgggaaagagcaatttcacccaataaagttccctactacatcaaccaccaggctcagaccacatgctgggaccatcccaagatgacagagttataccaaaccctagctgatctgaacaacattaagttctcagcttatcgcactgccatgaaactccgcagagtccagaaagccctgcgcttggacctggtaactttaaccacagccctggaaatcttcaatgagcatgatctgcaggccagtgagcacgtgatggatgtggtagaggtcattcactgcctgactgccttatatgaacgtttggaggaggaaagaggcatcctggtcaacgtgccactctgtgtggacatgagcctcaattggctcctcaatgtttttgatagtggtcgcagcggaaagatgcgggcattgtcttttaagactggcattgcatgcttgtgtggcacggaagtgaaggaaaaacttcagtacctcttcagccaagtggccaactcaggcagccagtgtgaccagcgccaccttggtgtcctgcttcatgaggccattcaggtgccccgtcagctgggtgaagtggcagcctttgggggcagcaatgtggagcccagtgtccgtagttgcttccgttttagcaccgggaagccagtcattgaagcatcccagttcctggagtgggtcaacctggagccccagtccatggtgtggctggctgttctgcatcgggtcaccattgctgagcaagtgaagcatcagaccaagtgctctatctgtaggcagtgccccatcaaggggttcaggtaccggagtctgaagcaattcaacgttgacatctgccagacctgcttcttgacaggcagggccagcaaaggcaataagctgcactaccccatcatggagtattacacaccgaccacatccagtgagaacatgagggactttgccacaaccttaaagaacaaattccgctccaagcattatttcagcaaacaccctcagcgaggttatctgcctgtgcaatcagtgctggaggctgactacagtgagacgccggcttcttccccgatgtggccacacgccgacacacactcccgaattgagcattttgccagcaggcttgctgagatggaaagtcaaaattgctccttctttaatgacagcttgtccccagatgacagcatagacgaggaccagtacctgctgcggcactccagccccatcacagaccgggagccagcctttggacagcaggctccatgcagtgtggccacagaaagcaaaggggagctacagaagatcctggcccacttggaagatgagaaccggattctccagggagagctgaggcgcctgaagtggcagcatgaggaggcagctgaggcacccagtctggctgacggctccactgaggcagcaacagaccaccgcaatgaggagcttctggccgaggcccgtatccttcggcaacataagagccgcctggagacgcgcatgcagatcctcgaagatcacaacaagcagctagagtcccagctgcagcgtctgagggagcttctcctgcagccacccaccgaatcagatggcagtggctctgcaggctcgtccctagcttcctctccacagcagtcagaaggcagtcacccccgggagaagggacagactactccagataccgaggctgcagatgatgtggggtcaaagagccaggatgtcagcctgtgcttggaggacatcatggagaaactccgtcatgccttccccagtgtgcgaagttctgatgtgactgccaacaccctgctggcctcttgatggagccagatccccatcctatagttcatagtcctctcctggttccggtcaaagcctttcctcagccttcacccaacctttccagtttccactggccccacattcctcaactagtattatttgggctctgggcagcagcagggatctggtggtatgtgaggtgcatgcgggcagtgatgggagaaggggaggcatgattcttctgaccctagaaatgttccctttaatcttcaagttcgagatcagccctttaagtacctttctgttgcagcccaggcaaatatcacttggccattcagatggggagcagagaagctgccttgcagagctaagcggtacatgttggcccctcttccttctccgtggaattatggaaagagagaagcctaattaccccaaggttccatccagcattatgaatccacagggtttacccctactctctggcgcaactcagggaggcaaaagggtatccccgagacaccttccccaccccaagtgcccctgaaaaagtctgggcagtgtgtgttctattacttcagctccaggacagattgctagccatcctaatgctacctaggtattggtttctcctcaaatatcttcattttctttagcctcagtccctgacagaccttccttaaggggagaacagttcattctggttcttctacgttatatttggaagcattaaatccatacttatgggtttagattttttttttgccccacatcttcctatttcttaaagtcctcagcattttgagagacccactgagttgcgagttgctctggaaacctggctgaagccaccctttgctcctctgagtctgtcctcacagacctgaggacacagtggcagcttgctgagcaagggagtgttgctttccttgggtaaggaagaggaagcccacctcaagtctggagtagtatgactgccatccaacacccttccaggctgtgacccttctagctctcaggctgaatcaggtgaggtggctgattgtccccagctaatcataaggcatttgcaactggctaccgtgtgtagtggcccctccataggagccacaggccacaaatcaggaagctggccactttccacccagacaacaacagcaaggccttcctgtgcctaaaattgttatttctaactctggaaggtgaatccaatcctcaaactgaactagctcttcctaggcgacatataccatgatctctttatccagaaactgttcagaatagatagtaggggtgggggagtgggcttgggaatgttgaatagattcagagcccacttaggcagctttctcccaagaggagctttataacctagagccctgcagttgacttcatttgcctaagtttatatacatacatatctattctacatatctactgtacatcagtgctctcctggcctcactcacacattaaattctaatacctcttgaagtattaatgttctgccttgctctttgttagccccagcctctggttggaaagatagatgtatcctggctgttcccctaggatatctctctccattgatgtttggggtgggctgtcctcaagaccaaagcaacagaaacctgtggtcacagagaatctaacaggaagagtcactgttctcttcactcattccaaatcttgttcccttgagacctgggccttgggtgaattttcctgggctcccctaaatggttcaggtgccaaaatagagcaaacccaagctctgcccaccccatgcagaaaaggacaaacaggcctttattagcctttgccagctaagacacagagaacattctctggtcccttccagctcttatggtctcactcagggctaaagaaagcaacagttgccaccacaatcaggagggagtgacggttggggtgttgtattataatccagcagtgggccagtgggtagaactgctaggaacctagtttgatctgctgcaggggaggcagggcagtggcttgggtccagaagcttagggttgcctcctccaccactaagtcacaggtccagggtgtcagacttcacagcataacatctgccttagtgttcatgaggtctctgggcaggagaactgggtatctggatagatggttgagcaggtggtaggcgggcatcaatcatagaacctgggcatcagtcagagtgggagcatatttgtagaagcctagattgtgggcgggaatgtgggacggagggctcaaggactttggaggcatatgcctgcctaagccttaggcgggtacatgttatggagcaattttttaccaggaaagtcctggaaaatcttttctgttatccccaccccacctgagagctcttgggctgctgagggcctgtggcaactgcagtgggccaggcatggtagaaaagatgtagatcttgttatgtaggatttgcgttgtaggtggactgaagcagcaggtcaagagttgaattctcactaaggggtcactgacattttgtggtcctgtgtttaccttaatgcctaaggtgagtgtattgttcaagggtccagggacagtcactgcagtatgtgtggggaattttcccacagtaaggtaaatggatccttgggtactatgaatccaacttggggttggatttaccaaaatgtgttgtatgttgttagacatcttgttgtgtattagtcttctaaggatattgtgcatggcactgtgtagtttatagccctacactggaaggatggtgaagggagttgctagattgatagcctaaagaaaaccttctgactgtgggattagcatcaatgataaggaatgtgagcatttgctggggttgttgtcaaatagtatcagagaacagttaggactgagaggtgatttcttcttgacagaatttgatagaggccaaaaagccattacgaggatacctctgcttccagtgacagcagagtggattcacattgattgggcattgtcacggaaggctgactagctggaggacatcaggctgtgctatgcttccctagggaggacatgtgcccttccctccagattagaaaggctagaatcaagagtttcaagtgctcattttcttcaaggtccaaggttgggaactatttccctacagagaaatctgtttgagtttctggtgctccaggaaatgggttggcaggacacagaaatgagaaaccctgaggccaggaagaggccaatcctaggagatgttttccctccagattcattttaaggaatatctgtgcttcctgatgtgtgtgcttgagatttgggctctatatccagcatttgaactcacattctcagtggcagagtcatggtctgtggcaccatttcaaggccaaaaatcccatccaatttcccttcacatagatgacagaaaagcaagaaagtagctgccttaactcgaacagttctgggaaaaaaactgggggccttgtcctgaggctgtggagacttaattcttcagctgggtggttcccgtaggaacaaggaacactttagctacttcttactcttttaacaccaatggctgtgggagaaggaaaggctcaaggccagggctcagctcgcagagtccatcttctcccacagttgccacatttgagagggggcctgctgaatgcccttgctgtcccctatggcagtattgaggcctgaccgaagtctggtatgctgcttgctggctacaagaactggtcacaggatgaaaattggggaaaggatttgggggaggtgacaagggtggcatggaagtctaggggacaaagggacagggttgggaacaaattggttaactttgattgccactcactgtggtgctttccccctttcccttgaattctgctttgaaaagaataaatttgtacttgttta

SEQ ID NO: 9155 - DNA, 6852 bp, Homo sapiens
ctaggtcttgactcgaaatctctctgtattgcttttccaggtgcttaatgatcaatagttggtgcactgcctatcctcatcccccccatgagccttggtttttatgcaacctatggtcatgcagggatgcccttacaccctcccacgatgtcatgactggcaggcagctgaccagttccatcatagcagcagcctccgaagcacctgcccccaccctcaggttagagctgctgtcaccagccctgcacctcctcaagatggtgctggggttccctgcctaagcctaaagctgttgaacgggtctgttggtgcctctggacccctggaaccaccagccatgaatctgtgttggaatgaaataaaaaagaagtctcacaacctccgcgctcgcctagaggccttctcagaccacagtggaaagcttcagctccctcttcaagagattattgactggctcagccaaaaggatgaggagttgtcagctcagctgcccctacagggggatgtggccctggtgcaacaggagaaggagacacatgcggcctttatggaagaagtcaagtctcggggcccctacatctattctgtgctggagtcagctcaggccttcctgtcccagcacccatttgaggagttagaggagcctcattctgagagcaaagatacctccccgaaacagcggatccagaatctcagccgctttgtatggaagcaggcgacggtggccagtgaactgtgggagaagttgacagcccgctgtgtggaccagcaccgtcacattgagcggactctggagcagctcttggagattcaaggggcaatggaggaactaagcactactctgagccaagctgagggagtccgagccacttgggagcccattggggatctcttcattgattcactcccagagcacatccaggctattaagctgttcaaagaagaattctcccccatgaaagatggagtaaagttggtgaatgatctggcccaccaacttgccatttctgatgtgcacttgtcaatggagaattcccaggccctggaacagatcaacgtccgatggaaacaactacaggcgtcagttagtgagaggcttaagcagctccaggatgcccaccgggactttgggcctgggtcacagcactttctctcctcctctgtccaggttccctgggaaagagcaatttcacccaataaagttccctactacatcaaccaccaggctcagaccacatgctgggaccatcccaagatgacagagttataccaaaccctagctgatctgaacaacattaagttctcagcttatcgcactgccatgaaactccgcagagtccagaaagccctgcgcttggacctggtaactttaaccacagccctggaaatcttcaatgagcatgatctgcaggccagtgagcacgtgatggatgtggtagaggtcattcactgcctgactgccttatatgaacgtttggaggaggaaagaggcatcctggtcaacgtgccactctgtgtggacatgagcctcaattggctcctcaatgtttttgatagtggtcgcagcggaaagatgcgggcattgtcttttaagactggcattgcatgcttgtgtggcacggaagtgaaggaaaaacttcagtacctcttcagccaagtggccaactcaggcagccagtgtgaccagcgccaccttggtgtcctgcttcatgaggccattcaggtgccccgtcagctgggtgaagtggcagcctttgggggcagcaatgtggagcccagtgtccgtagttgcttccgttttagcaccgggaagccagtcattgaagcatcccagttcctggagtgggtcaacctggagccccagtccatggtgtggctggctgttctgcatcgggtcaccattgctgagcaagtgaagcatcagaccaagtgctctatctgtaggcagtgccccatcaaggggttcaggtaccggagtctgaagcaattcaacgttgacatctgccagacctgcttcttgacaggcagggccagcaaaggcaataagctgcactaccccatcatggagtattacacaccgaccacatccagtgagaacatgagggactttgccacaaccttaaagaacaaattccgctccaagcattatttcagcaaacaccctcagcgaggttatctgcctgtgcaatcagtgctggaggctgactacagtgagacgccggcttcttccccgatgtggccacacgccgacacacactcccgaattgagcattttgccagcaggcttgctgagatggaaagtcaaaattgctccttctttaatgacagcttgtccccagatgacagcatagacgaggaccagtacctgctgcggcactccagccccatcacagaccgggagccagcctttggacagcaggctccatgcagtgtggccacagaaagcaaaggggagctacagaagatcctggcccacttggaagatgagaaccggattctccagggagagctgaggcgcctgaagtggcagcatgaggaggcagctgaggcacccagtctggctgacggctccactgaggcagcaacagaccaccgcaatgaggagcttctggccgaggcccgtatccttcggcaacataagagccgcctggagacgcgcatgcagatcctcgaagatcacaacaagcagctagagtcccagctgcagcgtctgagggagcttctcctgcagccacccaccgaatcagatggcagtggctctgcaggctcgtccctagcttcctctccacagcagtcagaaggcagtcacccccgggagaagggacagactactccagataccgaggctgcagatgatgtggggtcaaagagccaggatgtcagcctgtgcttggaggacatcatggagaaactccgtcatgccttccccagtgtgcgaagttctgatgtgactgccaacaccctgctggcctcttgatggagccagatccccatcctatagttcatagtcctctcctggttccggtcaaagcctttcctcagccttcacccaacctttccagtttccactggccccacattcctcaactagtattatttgggctctgggcagcagcagggatctggtggtatgtgaggtgcatgcgggcagtgatgggagaaggggaggcatgattcttctgaccctagaaatgttccctttaatcttcaagttcgagatcagccctttaagtacctttctgttgcagcccaggcaaatatcacttggccattcagatggggagcagagaagctgccttgcagagctaagcggtacatgttggcccctcttccttctccgtggaattatggaaagagagaagcctaattaccccaaggttccatccagcattatgaatccacagggtttacccctactctctggcgcaactcagggaggcaaaagggtatccccgagacaccttccccaccccaagtgcccctgaaaaagtctgggcagtgtgtgttctattacttcagctccaggacagattgctagccatcctaatgctacctaggtattggtttctcctcaaatatcttcattttctttagcctcagtccctgacagaccttccttaaggggagaacagttcattctggttcttctacgttatatttggaagcattaaatccatacttatgggtttagattttttttttgccccacatcttcctatttcttaaagtcctcagcattttgagagacccactgagttgcgagttgctctggaaacctggctgaagccaccctttgctcctctgagtctgtcctcacagacctgaggacacagtggcagcttgctgagcaagggagtgttgctttccttgggtaaggaagaggaagcccacctcaagtctggagtagtatgactgccatccaacacccttccaggctgtgacccttctagctctcaggctgaatcaggtgaggtggctgattgtccccagctaatcataaggcatttgcaactggctaccgtgtgtagtggcccctccataggagccacaggccacaaatcaggaagctggccactttccacccagacaacaacagcaaggccttcctgtgcctaaaattgttatttctaactctggaaggtgaatccaatcctcaaactgaactagctcttcctaggcgacatataccatgatctctttatccagaaactgttcagaatagatagtaggggtgggggagtgggcttgggaatgttgaatagattcagagcccacttaggcagctttctcccaagaggagctttataacctagagccctgcagttgacttcatttgcctaagtttatatacatacatatctattctacatatctactgtacatcagtgctctcctggcctcactcacacattaaattctaatacctcttgaagtattaatgttctgccttgctctttgttagccccagcctctggttggaaagatagatgtatcctggctgttcccctaggatatctctctccattgatgtttggggtgggctgtcctcaagaccaaagcaacagaaacctgtggtcacagagaatctaacaggaagagtcactgttctcttcactcattccaaatcttgttcccttgagacctgggccttgggtgaattttcctgggctcccctaaatggttcaggtgccaaaatagagcaaacccaagctctgcccaccccatgcagaaaaggacaaacaggcctttattagcctttgccagctaagacacagagaacattctctggtcccttccagctcttatggtctcactcagggctaaagaaagcaacagttgccaccacaatcaggagggagtgacggttggggtgttgtattataatccagcagtgggccagtgggtagaactgctaggaacctagtttgatctgctgcaggggaggcagggcagtggcttgggtccagaagcttagggttgcctcctccaccactaagtcacaggtccagggtgtcagacttcacagcataacatctgccttagtgttcatgaggtctctgggcaggagaactgggtatctggatagatggttgagcaggtggtaggcgggcatcaatcatagaacctgggcatcagtcagagtgggagcatatttgtagaagcctagattgtgggcgggaatgtgggacggagggctcaaggactttggaggcatatgcctgcctaagccttaggcgggtacatgttatggagcaattttttaccaggaaagtcctggaaaatcttttctgttatccccaccccacctgagagctcttgggctgctgagggcctgtggcaactgcagtgggccaggcatggtagaaaagatgtagatcttgttatgtaggatttgcgttgtaggtggactgaagcagcaggtcaagagttgaattctcactaaggggtcactgacattttgtggtcctgtgtttaccttaatgcctaaggtgagtgtattgttcaagggtccagggacagtcactgcagtatgtgtggggaattttcccacagtaaggtaaatggatccttgggtactatgaatccaacttggggttggatttaccaaaatgtgttgtatgttgttagacatcttgttgtgtattagtcttctaaggatattgtgcatggcactgtgtagtttatagccctacactggaaggatggtgaagggagttgctagattgatagcctaaagaaaaccttctgactgtgggattagcatcaatgataaggaatgtgagcatttgctggggttgttgtcaaatagtatcagagaacagttaggactgagaggtgatttcttcttgacagaatttgatagaggccaaaaagccattacgaggatacctctgcttccagtgacagcagagtggattcacattgattgggcattgtcacggaaggctgactagctggaggacatcaggctgtgctatgcttccctagggaggacatgtgcccttccctccagattagaaaggctagaatcaagagtttcaagtgctcattttcttcaaggtccaaggttgggaactatttccctacagagaaatctgtttgagtttctggtgctccaggaaatgggttggcaggacacagaaatgagaaaccctgaggccaggaagaggccaatcctaggagatgttttccctccagattcattttaaggaatatctgtgcttcctgatgtgtgtgcttgagatttgggctctatatccagcatttgaactcacattctcagtggcagagtcatggtctgtggcaccatttcaaggccaaaaatcccatccaatttcccttcacatagatgacagaaaagcaagaaagtagctgccttaactcgaacagttctgggaaaaaaactgggggccttgtcctgaggctgtggagacttaattcttcagctgggtggttcccgtaggaacaaggaacactttagctacttcttactcttttaacaccaatggctgtgggagaaggaaaggctcaaggccagggctcagctcgcagagtccatcttctcccacagttgccacatttgagagggggcctgctgaatgcccttgctgtcccctatggcagtattgaggcctgaccgaagtctggtatgctgcttgctggctacaagaactggtcacaggatgaaaattggggaaaggatttgggggaggtgacaagggtggcatggaagtctaggggacaaagggacagggttgggaacaaattggttaactttgattgccactcactgtggtgctttccccctttcccttgaattctgctttgaaaagaataaatttgtacttgttt

SEQ ID NO: 9156 - DNA, 6835 bp, Homo sapiens
tagcaacacagagcagctctgagaggggaggaggaggagaagaaggaagacagggaagtgggagagacagagggagagtgtgcatacagcagctgtcggcatccctgtctcagggacttctttgctgattcacagaggcagcccagccccggcctcccagcttacagctgccgcctgcttctcagacctgacggaatcagaaggttagagctgctgtcaccagccctgcacctcctcaagatggtgctggggttccctgcctaagcctaaagctgttgaacgggtctgttggtgcctctggacccctggaaccaccagccatgaatctgtgttggaatgaaataaaaaagaagtctcacaacctccgcgctcgcctagaggccttctcagaccacagtggaaagcttcagctccctcttcaagagattattgactggctcagccaaaaggatgaggagttgtcagctcagctgcccctacagggggatgtggccctggtgcaacaggagaaggagacacatgcggcctttatggaagaagtcaagtctcggggcccctacatctattctgtgctggagtcagctcaggccttcctgtcccagcacccatttgaggagttagaggagcctcattctgagagcaaagatacctccccgaaacagcggatccagaatctcagccgctttgtatggaagcaggcgacggtggccagtgaactgtgggagaagttgacagcccgctgtgtggaccagcaccgtcacattgagcggactctggagcagctcttggagattcaaggggcaatggaggaactaagcactactctgagccaagctgagggagtccgagccacttgggagcccattggggatctcttcattgattcactcccagagcacatccaggctattaagctgttcaaagaagaattctcccccatgaaagatggagtaaagttggtgaatgatctggcccaccaacttgccatttctgatgtgcacttgtcaatggagaattcccaggccctggaacagatcaacgtccgatggaaacaactacaggcgtcagttagtgagaggcttaagcagctccaggatgcccaccgggactttgggcctgggtcacagcactttctctcctcctctgtccaggttccctgggaaagagcaatttcacccaataaagttccctactacatcaaccaccaggctcagaccacatgctgggaccatcccaagatgacagagttataccaaaccctagctgatctgaacaacattaagttctcagcttatcgcactgccatgaaactccgcagagtccagaaagccctgcgcttggacctggtaactttaaccacagccctggaaatcttcaatgagcatgatctgcaggccagtgagcacgtgatggatgtggtagaggtcattcactgcctgactgccttatatgaacgtttggaggaggaaagaggcatcctggtcaacgtgccactctgtgtggacatgagcctcaattggctcctcaatgtttttgatagtggtcgcagcggaaagatgcgggcattgtcttttaagactggcattgcatgcttgtgtggcacggaagtgaaggaaaaacttcagtacctcttcagccaagtggccaactcaggcagccagtgtgaccagcgccaccttggtgtcctgcttcatgaggccattcaggtgccccgtcagctgggtgaagtggcagcctttgggggcagcaatgtggagcccagtgtccgtagttgcttccgttttagcaccgggaagccagtcattgaagcatcccagttcctggagtgggtcaacctggagccccagtccatggtgtggctggctgttctgcatcgggtcaccattgctgagcaagtgaagcatcagaccaagtgctctatctgtaggcagtgccccatcaaggggttcaggtaccggagtctgaagcaattcaacgttgacatctgccagacctgcttcttgacaggcagggccagcaaaggcaataagctgcactaccccatcatggagtattacacaccgaccacatccagtgagaacatgagggactttgccacaaccttaaagaacaaattccgctccaagcattatttcagcaaacaccctcagcgaggttatctgcctgtgcaatcagtgctggaggctgactacagtgagacgccggcttcttccccgatgtggccacacgccgacacacactcccgaattgagcattttgccagcaggcttgctgagatggaaagtcaaaattgctccttctttaatgacagcttgtccccagatgacagcatagacgaggaccagtacctgctgcggcactccagccccatcacagaccgggagccagcctttggacagcaggctccatgcagtgtggccacagaaagcaaaggggagctacagaagatcctggcccacttggaagatgagaaccggattctccagggagagctgaggcgcctgaagtggcagcatgaggaggcagctgaggcacccagtctggctgacggctccactgaggcagcaacagaccaccgcaatgaggagcttctggccgaggcccgtatccttcggcaacataagagccgcctggagacgcgcatgcagatcctcgaagatcacaacaagcagctagagtcccagctgcagcgtctgagggagcttctcctgcagccacccaccgaatcagatggcagtggctctgcaggctcgtccctagcttcctctccacagcagtcagaaggcagtcacccccgggagaagggacagactactccagataccgaggctgcagatgatgtggggtcaaagagccaggatgtcagcctgtgcttggaggacatcatggagaaactccgtcatgccttccccagtgtgcgaagttctgatgtgactgccaacaccctgctggcctcttgatggagccagatccccatcctatagttcatagtcctctcctggttccggtcaaagcctttcctcagccttcacccaacctttccagtttccactggccccacattcctcaactagtattatttgggctctgggcagcagcagggatctggtggtatgtgaggtgcatgcgggcagtgatgggagaaggggaggcatgattcttctgaccctagaaatgttccctttaatcttcaagttcgagatcagccctttaagtacctttctgttgcagcccaggcaaatatcacttggccattcagatggggagcagagaagctgccttgcagagctaagcggtacatgttggcccctcttccttctccgtggaattatggaaagagagaagcctaattaccccaaggttccatccagcattatgaatccacagggtttacccctactctctggcgcaactcagggaggcaaaagggtatccccgagacaccttccccaccccaagtgcccctgaaaaagtctgggcagtgtgtgttctattacttcagctccaggacagattgctagccatcctaatgctacctaggtattggtttctcctcaaatatcttcattttctttagcctcagtccctgacagaccttccttaaggggagaacagttcattctggttcttctacgttatatttggaagcattaaatccatacttatgggtttagattttttttttgccccacatcttcctatttcttaaagtcctcagcattttgagagacccactgagttgcgagttgctctggaaacctggctgaagccaccctttgctcctctgagtctgtcctcacagacctgaggacacagtggcagcttgctgagcaagggagtgttgctttccttgggtaaggaagaggaagcccacctcaagtctggagtagtatgactgccatccaacacccttccaggctgtgacccttctagctctcaggctgaatcaggtgaggtggctgattgtccccagctaatcataaggcatttgcaactggctaccgtgtgtagtggcccctccataggagccacaggccacaaatcaggaagctggccactttccacccagacaacaacagcaaggccttcctgtgcctaaaattgttatttctaactctggaaggtgaatccaatcctcaaactgaactagctcttcctaggcgacatataccatgatctctttatccagaaactgttcagaatagatagtaggggtgggggagtgggcttgggaatgttgaatagattcagagcccacttaggcagctttctcccaagaggagctttataacctagagccctgcagttgacttcatttgcctaagtttatatacatacatatctattctacatatctactgtacatcagtgctctcctggcctcactcacacattaaattctaatacctcttgaagtattaatgttctgccttgctctttgttagccccagcctctggttggaaagatagatgtatcctggctgttcccctaggatatctctctccattgatgtttggggtgggctgtcctcaagaccaaagcaacagaaacctgtggtcacagagaatctaacaggaagagtcactgttctcttcactcattccaaatcttgttcccttgagacctgggccttgggtgaattttcctgggctcccctaaatggttcaggtgccaaaatagagcaaacccaagctctgcccaccccatgcagaaaaggacaaacaggcctttattagcctttgccagctaagacacagagaacattctctggtcccttccagctcttatggtctcactcagggctaaagaaagcaacagttgccaccacaatcaggagggagtgacggttggggtgttgtattataatccagcagtgggccagtgggtagaactgctaggaacctagtttgatctgctgcaggggaggcagggcagtggcttgggtccagaagcttagggttgcctcctccaccactaagtcacaggtccagggtgtcagacttcacagcataacatctgccttagtgttcatgaggtctctgggcaggagaactgggtatctggatagatggttgagcaggtggtaggcgggcatcaatcatagaacctgggcatcagtcagagtgggagcatatttgtagaagcctagattgtgggcgggaatgtgggacggagggctcaaggactttggaggcatatgcctgcctaagccttaggcgggtacatgttatggagcaattttttaccaggaaagtcctggaaaatcttttctgttatccccaccccacctgagagctcttgggctgctgagggcctgtggcaactgcagtgggccaggcatggtagaaaagatgtagatcttgttatgtaggatttgcgttgtaggtggactgaagcagcaggtcaagagttgaattctcactaaggggtcactgacattttgtggtcctgtgtttaccttaatgcctaaggtgagtgtattgttcaagggtccagggacagtcactgcagtatgtgtggggaattttcccacagtaaggtaaatggatccttgggtactatgaatccaacttggggttggatttaccaaaatgtgttgtatgttgttagacatcttgttgtgtattagtcttctaaggatattgtgcatggcactgtgtagtttatagccctacactggaaggatggtgaagggagttgctagattgatagcctaaagaaaaccttctgactgtgggattagcatcaatgataaggaatgtgagcatttgctggggttgttgtcaaatagtatcagagaacagttaggactgagaggtgatttcttcttgacagaatttgatagaggccaaaaagccattacgaggatacctctgcttccagtgacagcagagtggattcacattgattgggcattgtcacggaaggctgactagctggaggacatcaggctgtgctatgcttccctagggaggacatgtgcccttccctccagattagaaaggctagaatcaagagtttcaagtgctcattttcttcaaggtccaaggttgggaactatttccctacagagaaatctgtttgagtttctggtgctccaggaaatgggttggcaggacacagaaatgagaaaccctgaggccaggaagaggccaatcctaggagatgttttccctccagattcattttaaggaatatctgtgcttcctgatgtgtgtgcttgagatttgggctctatatccagcatttgaactcacattctcagtggcagagtcatggtctgtggcaccatttcaaggccaaaaatcccatccaatttcccttcacatagatgacagaaaagcaagaaagtagctgccttaactcgaacagttctgggaaaaaaactgggggccttgtcctgaggctgtggagacttaattcttcagctgggtggttcccgtaggaacaaggaacactttagctacttcttactcttttaacaccaatggctgtgggagaaggaaaggctcaaggccagggctcagctcgcagagtccatcttctcccacagttgccacatttgagagggggcctgctgaatgcccttgctgtcccctatggcagtattgaggcctgaccgaagtctggtatgctgcttgctggctacaagaactggtcacaggatgaaaattggggaaaggatttgggggaggtgacaagggtggcatggaagtctaggggacaaagggacagggttgggaacaaattggttaactttgattgccactcactgtggtgctttccccctttcccttgaattctgctttgaaaagaataaatttgtacttgttt

SEQ ID NO: 9157 - DNA, 12025 bp, Homo sapiens
cactgagcggctgcggcgcggcttccatcctcccgccctcctgacgcggccggagcgcagccctgaggcccagggagaacgacacattggatacagaagggaggtgatcatgcaccatggcactggcccccagaacgtccagcatcagctgcagaggtccagggcctgccctggcagcgagggtgaggagcagccggcccaccccaacccacccccgtcccccgcagctcccttcgctccctcagcaagcccgtcggcaccccagtctcccagttatcaaatacagcagctgatgaataggagccctgcaaccgggcagaacgtgaacatcaccctgcagagcgtgggccctgtcgtcgggggaaaccagcagatcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacagggggcttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacacccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaagaagaaacattatgccccattacaagcatatcttaggcagaatgatttggacattgaagaagaggaggaggaggaggaagaggaggaagaaaaatctgaggttatcaatgacgagcagcaagccctcgcagggagcctggtagcaggggccggaagcacagtagagacggacctgtttaagaggcagcaggcgatgccctccacaggtatggcagagcagtctaagaggcctcgccttgaagtgggtcaccaaggggtagttttccagcacccaggggcggacgcaggcgttcctctccagcaactaatgccgaccgcacaaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaaggtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatgcctacagcatggagtatgtctacgaagatgtcgatgggcagacagaagtcatgccgctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcagctgcaggcaggaagaagaagcagcgtcacggggaggcggtcgtccctcctcggtccctgtttgaccgcgcaacaccaggacttctgaaaattcgcagagagggcaaggagcagaagaagaatattctgctgaagcagcaggtgccattcgccaagcccctgccaacttttgccaaacccacagctgagcctggtcaagacaaccccgagtggctcatcagtgaggactgggcgctgctgcaggctgtaaagcagttactggagctgcctttgaacctcacaatcgtgtcacctgctcacacacctaattgggatcttgtcagtgacgttgttaactcctgtagccgaatctaccgctcttccaaacagtgccggaatcgctacgagaatgtcatcattccacgagaggaggggaagagtaaaaacaaccgtcctctccgtacgagccagatctatgcccaggatgagaatgccacacacacccagctgtacacgagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccttccagtccatcaacaagcgcctggcgtcgccagtggctcctggggccttgactacgccgggaggctctgctcccgcccaggtggtgcacacccagcccccgccacgggcagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcaacaacagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccaacagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcagctgcaggcgcaagggcagatgcagacccaggcaccccagccagcccaggtggccttggcgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggcccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgattgacagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagcttgccggagggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttatata

SEQ ID NO: 9158 - DNA, 12157 bp, Homo sapiens
cactgagcggctgcggcgcggcttccatcctcccgccctcctgacgcggccggagcgcagccctgaggcccagggagaacgacacattggatacagaagggaggtgatcatgcaccatggcactggcccccagaacgtccagcatcagctgcagaggtccagggcctgccctggcagcgagggtgaggagcagccggcccaccccaacccacccccgtcccccgcagctcccttcgctccctcagcaagcccgtcggcaccccagtctcccagttatcaaatacagcagctgatgaataggagccctgcaaccgggcagaacgtgaacatcaccctgcagagcgtgggccctgtcgtcgggggaaaccagcagatcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacagggggcttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacacccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaagaagaaacattatgccccattacaagcatatcttaggcagaatgatttggacattgaagaagaggaggaggaggaggaagaggaggaagaaaaatctgaggttatcaatgacgagcaagccctcgcagggagcctggtagcaggggccggaagcacagtagagacggacctgtttaagaggcagcaggcgatgccctccacaggtatggcaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaagcagcagcagccccgtttcagacctctcaggcttccgccagtgctccacgacaccagcccgcctcggcctccagcacagccgctagcccggcccatcctgcgaaactgcgggcccagaccacagcacaggcctccaccccaggccagcccccgccccagccccaggccccctcgcacgcggccgggcagagcgcgctgcctcagaggctggtgctcccctcgcaggcccaggcccgcttgcccagtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatgcctacagcatggagtatgtctacgaagatgtcgatgggcagacagaagtcatgccgctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcagctgcaggcaggaagaagaagcagcgtcacggggaggcggtcgtccctcctcggtccctgtttgaccgcgcaacaccaggacttctgaaaattcgcagagagggcaaggagcagaagaagaatattctgctgaagcagcaggtgccattcgccaagcccctgccaacttttgccaaacccacagctgagcctggtcaagacaaccccgagtggctcatcagtgaggactgggcgctgctgcaggctgtaaagcagttactggagctgcctttgaacctcacaatcgtgtcacctgctcacacacctaattgggatcttgtcagtgacgttgttaactcctgtagccgaatctaccgctcttccaaacagtgccggaatcgctacgagaatgtcatcattccacgagaggaggggaagagtaaaaacaaccgtcctctccgtacgagccagatctatgcccaggatgagaatgccacacacacccagctgtacacgagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccttccagtccatcaacaagcgcctggcgtcgccagtggctcctggggccttgactacgccgggaggctctgctcccgcccaggtggtgcacacccagcccccgccacgggcagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcaacaacagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccaacagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcagctgcaggcgcaagggcagatgcagacccaggcaccccagccagcccaggtggccttggcgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggcccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgattgacagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagcttgccggagggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttatata

SEQ ID NO: 9159 - DNA, 12376 bp, Homo sapiens
cactgagcggctgcggcgcggcttccatcctcccgccctcctgacgcggccggagcgcagccctgaggcccagggagaacgacacattggatacagaagggaggtgatcatgcaccatggcactggcccccagaacgtccagcatcagctgcagaggtccagggcctgccctggcagcgagggtgaggagcagccggcccaccccaacccacccccgtcccccgcagctcccttcgctccctcagcaagcccgtcggcaccccagtctcccagttatcaaatacagcagctgatgaataggagccctgcaaccgggcagaacgtgaacatcaccctgcagagcgtgggccctgtcgtcgggggaaaccagcagatcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacagggggcttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacacccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaagaagaaacattatgccccattacaagcatatcttaggcagaatgatttggacattgaagaagaggaggaggaggaggaagaggaggaagaaaaatctgaggttatcaatgacgaggtaaaggttgtgacaggaaaggatgggcagactgggactcccgttgctatagcaacccagcttccgccaaaggtttctgctgctttttcatcccagcagcaaccatttcagcaagccctcgcagggagcctggtagcaggggccggaagcacagtagagacggacctgtttaagaggcagcaggcgatgccctccacaggtatggcagagcagtctaagaggcctcgccttgaagtgggtcaccaaggggtagttttccagcacccaggggcggacgcaggcgttcctctccagcaactaatgccgaccgcacaaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaagcagcagcagccccgtttcagacctctcaggcttccgccagtgctccacgacaccagcccgcctcggcctccagcacagccgctagcccggcccatcctgcgaaactgcgggcccagaccacagcacaggcctccaccccaggccagcccccgccccagccccaggccccctcgcacgcggccgggcagagcgcgctgcctcagaggctggtgctcccctcgcaggcccaggcccgcttgcccagtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatgcctacagcatggagtatgtctacgaagatgtcgatgggcagacagaagtcatgccgctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcagctgcaggcaggaagaagaagcagcgtcacggggaggcggtcgtccctcctcggtccctgtttgaccgcgcaacaccaggacttctgaaaattcgcagagagggcaaggagcagaagaagaatattctgctgaagcagcaggtgccattcgccaagcccctgccaacttttgccaaacccacagctgagcctggtcaagacaaccccgagtggctcatcagtgaggactgggcgctgctgcaggctgtaaagcagttactggagctgcctttgaacctcacaatcgtgtcacctgctcacacacctaattgggatcttgtcagtgacgttgttaactcctgtagccgaatctaccgctcttccaaacagtgccggaatcgctacgagaatgtcatcattccacgagaggaggggaagagtaaaaacaaccgtcctctccgtacgagccagatctatgcccaggatgagaatgccacacacacccagctgtacacgagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccttccagtccatcaacaagcgcctggcgtcgccagtggctcctggggccttgactacgccgggaggctctgctcccgcccaggtggtgcacacccagcccccgccacgggcagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcaacaacagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccaacagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcagctgcaggcgcaagggcagatgcagacccaggcaccccagccagcccaggtggccttggcgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggcccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgattgacagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagcttgccggagggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttatata

SEQ ID NO: 9160 - DNA, 12268 bp, Homo sapiens
cactgagcggctgcggcgcggcttccatcctcccgccctcctgacgcggccggagcgcagccctgaggcccagggagaacgacacattggatacagaagggaggtgatcatgcaccatggcactggcccccagaacgtccagcatcagctgcagaggtccagggcctgccctggcagcgagggtgaggagcagccggcccaccccaacccacccccgtcccccgcagctcccttcgctccctcagcaagcccgtcggcaccccagtctcccagttatcaaatacagcagctgatgaataggagccctgcaaccgggcagaacgtgaacatcaccctgcagagcgtgggccctgtcgtcgggggaaaccagcagatcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacagggggcttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacacccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaagaagaaacattatgccccattacaagcatatcttaggcagaatgatttggacattgaagaagaggaggaggaggaggaagaggaggaagaaaaatctgaggttatcaatgacgagcagcaagccctcgcagggagcctggtagcaggggccggaagcacagtagagacggacctgtttaagaggcagcaggcgatgccctccacaggtatggcagagcagtctaagaggcctcgccttgaagtgggtcaccaaggggtagttttccagcacccaggggcggacgcaggcgttcctctccagcaactaatgccgaccgcacaaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaagcagcagcagccccgtttcagacctctcaggcttccgccagtgctccacgacaccagcccgcctcggcctccagcacagccgctagcccggcccatcctgcgaaactgcgggcccagaccacagcacaggcctccaccccaggccagcccccgccccagccccaggccccctcgcacgcggccgggcagagcgcgctgcctcagaggctggtgctcccctcgcaggcccaggcccgcttgcccagtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatgcctacagcatggagtatgtctacgaagatgtcgatgggcagacagaagtcatgccgctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcagctgcaggcaggaagaagaagcagcgtcacggggaggcggtcgtccctcctcggtccctgtttgaccgcgcaacaccaggacttctgaaaattcgcagagagggcaaggagcagaagaagaatattctgctgaagcagcaggtgccattcgccaagcccctgccaacttttgccaaacccacagctgagcctggtcaagacaaccccgagtggctcatcagtgaggactgggcgctgctgcaggctgtaaagcagttactggagctgcctttgaacctcacaatcgtgtcacctgctcacacacctaattgggatcttgtcagtgacgttgttaactcctgtagccgaatctaccgctcttccaaacagtgccggaatcgctacgagaatgtcatcattccacgagaggaggggaagagtaaaaacaaccgtcctctccgtacgagccagatctatgcccaggatgagaatgccacacacacccagctgtacacgagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccttccagtccatcaacaagcgcctggcgtcgccagtggctcctggggccttgactacgccgggaggctctgctcccgcccaggtggtgcacacccagcccccgccacgggcagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcaacaacagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccaacagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcagctgcaggcgcaagggcagatgcagacccaggcaccccagccagcccaggtggccttggcgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggcccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgattgacagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagcttgccggagggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttatata

SEQ ID NO: 9161 - DNA, 12265 bp, Homo sapiens
cactgagcggctgcggcgcggcttccatcctcccgccctcctgacgcggccggagcgcagccctgaggcccagggagaacgacacattggatacagaagggaggtgatcatgcaccatggcactggcccccagaacgtccagcatcagctgcagaggtccagggcctgccctggcagcgagggtgaggagcagccggcccaccccaacccacccccgtcccccgcagctcccttcgctccctcagcaagcccgtcggcaccccagtctcccagttatcaaatacagcagctgatgaataggagccctgcaaccgggcagaacgtgaacatcaccctgcagagcgtgggccctgtcgtcgggggaaaccagcagatcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacagggggcttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacacccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaagaagaaacattatgccccattacaagcatatcttaggcagaatgatttggacattgaagaagaggaggaggaggaggaagaggaggaagaaaaatctgaggttatcaatgacgagcaagccctcgcagggagcctggtagcaggggccggaagcacagtagagacggacctgtttaagaggcagcaggcgatgccctccacaggtatggcagagcagtctaagaggcctcgccttgaagtgggtcaccaaggggtagttttccagcacccaggggcggacgcaggcgttcctctccagcaactaatgccgaccgcacaaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaagcagcagcagccccgtttcagacctctcaggcttccgccagtgctccacgacaccagcccgcctcggcctccagcacagccgctagcccggcccatcctgcgaaactgcgggcccagaccacagcacaggcctccaccccaggccagcccccgccccagccccaggccccctcgcacgcggccgggcagagcgcgctgcctcagaggctggtgctcccctcgcaggcccaggcccgcttgcccagtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatgcctacagcatggagtatgtctacgaagatgtcgatgggcagacagaagtcatgccgctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcagctgcaggcaggaagaagaagcagcgtcacggggaggcggtcgtccctcctcggtccctgtttgaccgcgcaacaccaggacttctgaaaattcgcagagagggcaaggagcagaagaagaatattctgctgaagcagcaggtgccattcgccaagcccctgccaacttttgccaaacccacagctgagcctggtcaagacaaccccgagtggctcatcagtgaggactgggcgctgctgcaggctgtaaagcagttactggagctgcctttgaacctcacaatcgtgtcacctgctcacacacctaattgggatcttgtcagtgacgttgttaactcctgtagccgaatctaccgctcttccaaacagtgccggaatcgctacgagaatgtcatcattccacgagaggaggggaagagtaaaaacaaccgtcctctccgtacgagccagatctatgcccaggatgagaatgccacacacacccagctgtacacgagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccttccagtccatcaacaagcgcctggcgtcgccagtggctcctggggccttgactacgccgggaggctctgctcccgcccaggtggtgcacacccagcccccgccacgggcagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcaacaacagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccaacagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcagctgcaggcgcaagggcagatgcagacccaggcaccccagccagcccaggtggccttggcgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggcccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgattgacagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagcttgccggagggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttatata

SEQ ID NO: 9162 - DNA, 2585 bp, Homo sapiens
atgcactgagcggctgcggcgcggcttccatcctcccgccctcctgacgcggccggagcgcagccctgaggcccagggagaacgacacattggatacagaagggaggtgatcatgcaccatggcactggcccccagaacgtccagcatcagctgcagaggtccagggcctgccctggcagcgagggtgaggagcagccggcccaccccaacccacccccgtcccccgcagctcccttcgctccctcagcaagcccgtcggcaccccagtctcccagttatcaaatacagcagctgatgaataggagccctgcaaccgggcagaacgtgaacatcaccctgcagagcgtgggccctgtcgtcgggggaaaccagcagatcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacagggggcttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacacccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaagaagaaacattatgccccattacaagcatatcttaggcagaatgatttggacattgaagaagaggaggaggaggaggaagaggaggaagaaaaatctgaggttatcaatgacgagcaagccctcgcagggagcctggtagcaggggccggaagcacagtagagacggacctgtttaagaggcagcaggcgatgccctccacaggtatggcaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaag

SEQ ID NO: 9163 - DNA, 10014 bp, Homo sapiens
ggagaacgacacattggatacagaagggaggtgatcatgcaccatggcactggcccccagaacgtccagcatcagctgcagaggtccagggcctgccctggcagcgagggtgaggagcagccggcccaccccaacccacccccgtcccccgcagctcccttcgctccctcagcaagcccgtcggcaccccagtctcccagttatcaaatacagcagctgatgaataggagccctgcaaccgggcagaacgtgaacatcaccctgcagagcgtgggccctgtcgtcgggggaaaccagcagatcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacagggggcttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacacccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaagaagaaacattatgccccattacaagcatatcttaggcagaatgatttggacattgaagaagaggaggaggaggaggaagaggaggaagaaaaatctgaggttatcaatgacgagcagcaagccctcgcagggagcctggtagcaggggccggaagcacagtagagacggacctgtttaagaggcagcaggcgatgccctccacaggtatggcagagcagtctaagaggcctcgccttgaagtgggtcaccaaggggtagttttccagcacccaggggcggacgcaggcgttcctctccagcaactaatgccgaccgcacaaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggttgtggaaataaaactacgagtagaattagaagaaaaaaggaagaaggccttaaatttacagaaagtttccaggagagggaaagaattgagacctaaaggatttgacgcattacaggaaagttctctggattcaggaatgtctggaagaaaaagaaaagctagcatatctttgactgatgacgaagtggacgatgaagaggaaacaattgaagaggaggaagcaaatgaaggcgttgtggaccaccaaacagaactttctaatttagccaaggaagctgagctgcccctcctggacctgatgaagctgtacgaaggcgccttcctgccgagttctcagtggccccggccgaagcctgatggggaggacacaagcggagaggaagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaattggggcccccatcttgttgttgtgagaagttgtaacatactcaagtgggagcttgaattgaaacgttggtgtcccggactcaaaatcctctcatatattggcagccacagagaactcaaagcaaagagacaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtgacacagccatttattttgaggagaactaagagagatgtggaaaagcaactaacaaagaaatatgagcatgttttgaagtgtcgcctttctaaccgacaaaaagccttatacgaggacgttatcctgcaacctggcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaagcagcagcagccccgtttcagacctctcaggcttccgccagtgctccacgacaccagcccgcctcggcctccagcacagccgctagcccggcccatcctgcgaaactgcgggcccagaccacagcacaggcctccaccccaggccagcccccgccccagccccaggccccctcgcacgcggccgggcagagcgcgctgcctcagaggctggtgctcccctcgcaggcccaggcccgcttgcccagtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaagttggcgttccgggccgcgtggcggtgaatgccttggctgtaggagaacccggaacggcctccaaaccagcttctcccattggagggccgacccaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggcttgtgagtggcaattccattgaagagaaattgttgaaaaatggaactaaagatctgatccgagaagtggctgctcagggaaatgactactccatggctttcttaactcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcagcttacaccaattgaaaaatatgctttaaattacctggaattattccatacttctattgagcaagaaaaggagagaaacagtgaggacgcagtgatgactgcagtgagggcatgggagttctggaacctgaagaccctgcaggagagggaggcccggctgcggctggagcaggaggaggcggagctcctgacctacacgcgagaggatgcctacagcatggagtatgtctacgaagatgtcgatgggcagacagaagtcatgccgctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcagctgcaggcaggaagaagaagcagcgtcacggggaggcggtcgtccctcctcggtccctgtttgaccgcgcaacaccaggacttctgaaaattcgcagagagggcaaggagcagaagaagaatattctgctgaagcagcaggtgccattcgccaagcccctgccaacttttgccaaacccacagctgagcctggtcaagacaaccccgagtggctcatcagtgaggactgggcgctgctgcaggctgtaaagcagttactggagctgcctttgaacctcacaatcgtgtcacctgctcacacacctaattgggatcttgtcagtgacgttgttaactcctgtagccgaatctaccgctcttccaaacagtgccggaatcgctacgagaatgtcatcattccacgagaggaggggaagagtaaaaacaaccgtcctctccgtacgagccagatctatgcccaggatgagaatgccacacacacccagctgtacacgagccactttgacttaatgaaaatgactgctggcaagaggagtcccccaatcaaacctctgcttggcatgaatccctttcagaagaaccccaagcacgcgtctgtgttggcagaaagtggaatcaactatgacaagccgctgcctcccatccaggtggcatctctccgtgcagagcgaatcgcaaaagagaaaaaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggcaggaaccattaaaacatcagttactgggacgagcatgcccactggtgccgtgagtggaaatgtgatcgtgaacaccatcgcaggggtcccagctgccaccttccagtccatcaacaagcgcctggcgtcgccagtggctcctggggccttgactacgccgggaggctctgctcccgcccaggtggtgcacacccagcccccgccacgggcagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaagccacaggagttcagctccctggaaaaaccatcacacctgcacatttccagcttctcaggcagcagcagcagcagcagcaacaacagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggaacacctcatcaaaatgcagaagcagaaactgcagatgcccccgcagcccccaccgccacaggcccagtctgcgcccccgcagccaacagcccaagtgcaagtgcagacctcgcagccgccgcagcagcagagcccccagctcacgacggtcacggccccaaggcctggtgccctgctgacgggcaccaccgtggccaacctccaggtggcccggctcacccgggttcccacttctcagctgcaggcgcaagggcagatgcagacccaggcaccccagccagcccaggtggccttggcgaagcctccggtggtgtccgtcccggcagctgtggtctcctcaccgggagtcaccaccctgcccatgaacgtcgcggggatcagcgtggcgatcggtcagccacagaaggcagcaggacagaccgtggtggcccagcccgtgcacatgcagcagctgctgaagctgaagcagcaggccgtccagcagcagaaggccatccagccccaggctgcacagggcccggcagccgtccagcagaagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggttgcaaaacttcctcaagttgttcaacagcaaacacccgtggccagcatccagcaagttgcctctgcttcccagcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacc

SEQ ID NO: 9164 - DNA, 5191 bp, Homo sapiens
aggactagagagcgagccgcaaggaagtcggtgcagtcgagacccccctccccatcccagcgcatcgcgtctccgccgagcttgagggcacgccggggacccctccccagagccggccggaccccaggtgccgaggccttggggagcgcggggcgtcccgggtcgcggtgccctcgggacgagacagcccctggcagtgccaccaccgcagccgccgggcgatctccaagcggcgatctctaagcgctgctctctgctcggccgcgggccaggaggggagggtccggccttgccccgcaggcgtccattggcggcttcccccggcctccgcgccatgccgcgggccgtgtgaaaggcggcagcaccggaacccgcaggtgtccgcgggcgcgccaagcccttttgggtagggggcgccttactcgctatgctgcaagggccccgggccttggcttcggccgctgggcagaccccgaaggtggtgcccgcgatgagccccacagagctgtggccatccggcctcagcagcccccagctctgcccagctactgctacctactacacaccgctgtacccgcagacggcgcctcccgcagcggcgccaggcacctgcctcgacgccactccccacggacccgagggccaagttgtgcgatgcctgccggcaggccggctgccggccaaaaggaagctggatctggaggggattgggaggcccgtcgtccctgagttcccaacccccaaggggaagtgcatcagagtggatggcctccccagccccaaaacccccaaatcccccggggagaagactcggtatgacacttcgctggggctgctcaccaagaagttcatttacctcctgagcgagtcagaggatggggtcctggacctgaactgggccgctgaggtgctggacgtgcagaagcggcgcatctatgacatcaccaacgtgctggaaggcatccagctcatccgcaagaaggccaagaacaacatccagtgggtaggcaggggaatgtttgaagaccccaccagacctgggaagcagcaacagctggggcaggagctgaaggagctgatgaacacggagcaggccttggaccagctcatccagagctgctctctgagcttcaagcacctgactgaggacaaggccaacaagaggctggcctatgtgacttaccaggatatccgtgctgttggcaactttaaggagcagacagtgattgccgtcaaggcccctccgcagacgagactggaagtgcccgacaggactgaggacaacctgcagatatatctcaagagcacccaagggcccatcgaagtctacctgtgcccagaggaggtgcaggagccggacagtccttccgaggagcctctcccctctacctccaccctctgccccagccctgactctgcccagcccagcagcagcaccgaccctagcatcatggagcccacagcatcctcagtgccagcaccagcgccaaccccccagcaggccccaccgcctccatccctggtccccttggaggctactgacagcctgctggagctgccgcacccactcctgcagcagactgaggaccagttcctgtccccgaccctggcgtgcagctcccctctgatcagcttctccccatccttggaccaggacgactacctgtggggcttggaggcgggtgagggcatcagcgatctcttcgactcctacgaccttggggacctgttgattaattgagtggccctgcctgcccccagcagcctgcccccgactctacctcctcacagacaggctgacagcccctctgcctgcacagggacattggacactaggtgctgccctcagggcatggggtctcctcgcctttcctgccccagccggcagaagctgtgtggggagatatgaatggtacgggtgaggagtggataaggggtggtcctcaccttcctaatggaagctgggcctagggaggcccatccagtcttctgacttctgacctctcacaagaaggctgcaggtgaggtggccaagtccagggaaaggccctgctacctccttttgaggggtaattaggaccctcgacgtaccaagaagcacataatgcctttgtatttatttcaggttgagttgtttgtttgtcctccctgagttttagcagggaggttgttctagtttttagtgagacctctgcagacaggcccatcactgtccatgttccagggcaggtctgggtttccaagggaggggcccaggctacatccttggtttccccactgtggtgggggctgggactctgaggggctgtccagtctgctagaatgctaattgcacttaggcctcatggttctagtaaacggcagctgtgggcccttttgcctcttcccctgttcttggcctcacatctccagctgagctgccggtcttggcttcctggtcgcctctgtcccagagatggtcccagggagccatcctagggcaggtagcactgaggctcctgtggaaacaggagccacctgctcaggagacccctttcctgaggaagtccttacctctccccttgagatgtaaaaatggtccagcagagacaagctcccgtggaaaacagacaggagcatgggggcagctgtcatggctgtggcgggcacttttcctcagagtttctgccttgcgctggtccaggagccattttgcaccaaggacttggtaggcagaggcagccccactgtaaagaagggtcagattaaaacaaaaaactgccaaaagcatcccctctgccccccatgtggcactggcatcattctctgcttccctgggaggaattttttcaccatgttattgaaggggatggttcattaaggactccacccctcagagctcactcagaccccaaggacagaggtgactggggcttggtgacttgttcactccttttttcccaggtatactgaaggggtgacagagagaggtcttcatggcagaccaggccttcacagctaatggggagaggaactcatgttacctctgcaggcctggggtcctgagggggtcttttggcttcagcctgttcccccagaggcttgatcatcccacattgtcccttcagctcagctgctcttctcccccacccaccctgggatgtgggtgctctgggctgaaccaaggctatgacttctggagagaggctcaggggttggtctgagaggcctgccatccacccctcagggagctaggttttctcagaggctcagctggacagcactttttagaaaagtttgtagcattaagctggtttaaaatatgaagttggttttgttggatggctcctgagctgactgactgatgtctgaagtttgagacgagggattatttcagggtggggcccaatgtgatctaatgcccagctggggacaattgtgcctcatcatttgctcaaattcctgggcccccaagttagccccctcccaggagtggtcagcgggtcacagctgcccccactctataagcagggctaattgtgtaccctttgcagaaatgcttttggtctcctacccaaatactcacaagggtcttatcagacgcccgtcttaaagtccagcatgctcagggaccctgtgtaggatctcgtttgtggtgagtgggctgctctgaggtctccactgggctgccatttagccatgtgccatctctgaagtcagaggtgtttgactcccattccttgggctctggagctttccccaagaattacatcagagaaaaggaagaaggggcctgcaggacccattgggaatgagtttaatactgaagtctggaatgtaagctcatgccctagaggcctctccatatggctggtcaggggagctgccttcaggcttgtgccccgtgtgctcagcagctgcctctgtccccctctactgtccctttcacaccttgcctggccaaggggctagacctcccaggctaagcctcagattcagtgcaggacacaagctcatgcccccgtcttgccagtgacacttgaagcctcccgacttccacagagtgcttcaggacacattttgagtggtattttcttttctttttttcttctttttttttttttttgagatggagtctcgctctgttgcccaggctggagtgcagtggcctgatctcggctcactgcaacctctgcctcccaggttcaagcgattcttctgcctcagcctccagagtagctgggactatagacatgcaccaccacgcccggctaattttgtatttttggtcgagacggggttttgccatgttagtcaggctggtcttgaactcctgacctcaagtgatccaccacctcggcctcccaaagtgttgagatgacaggcacgagccaccaggcccagcctgagtggtattttctttagggaccaggtagactttaaaacgagggtaagagaaaagccagtgtctttctgaggtaaataatttctgccaggaaacttcccagccccaccagcagcccccctaaaaaaatcactcgtgtccccagggacttctaaagcttggggctccaggaaatcatccagtagagttggagattcagagatttcttgaagccagggacatgctcctaactcctttcccattaaaggtgttagaatagaccagagggtgtcccttttccacagtaatgggatcggctggtgtgccttcagggaggaagagggaggtggtcaagcttgaaaaactggctttaggatggttctgactttgttctccctccccaagtgttctcaacctccattctgcagtgttcagagttttagggaaagggtttgggtgccccagcatccaggtgttgtgtggcttagcgcatgtgaagtgaaaaccttctggggttgtttggaagcagctttctggttcttgtgattgtatcctgaggtcccagaaccctattctcccacgaggatcctcagtgaccatggtggccacacgcctggccagcctgctggctcctgggtgagctgaagaaccttgcctgtggcacttttcgagggtgagctggaaccgagagaacatggtccccgtgctgggactcatgcgggtcatttcctgccggcctggtttcgcctggtcgtgtctttatgagcaccatgtaagcctccttgtattgagataattgggcattaaacattaaactgcagctctggg

SEQ ID NO: 9165 - DNA, 4744 bp, Homo sapiens
aaataataaagaaattgaaaacaatacattaatataccataacactaaaaagagcaggagcgagagatgagaaagggaatccagcccgctctggagcagtacctggtgaccgccgggggtggggagggggcggctgtcgtcgccgccgccgctgcagcctccatggacaaaagggcactgctagccagccccggcttcgccgccgccgccgccgctgccgccgccccgggcgcgtacatccagatcctcaccacgaacacttccaccacctcctgttcctcctccctccaaagcggcgccgtagccgccggccccctcctccccagtgcccccggcgcggagcagaccgccggcagcctcctctacaccacgccgcacggaccctccagcagagccgggctgctgcagcagccaccagcgctgggacgcggcggcagcggcggcggcggcggccctccggcaaagcgaaggctggagctaggagaaagcggtcatcagtacctctcagatggtttaaaaacccccaagggcaaaggaagagctgcactacgaagtccagatagtccaaaaactccaaaatctccctcagaaaaaacgcggtatgatacgtctcttggtctgctcaccaagaagttcattcagctcctgagccagtcacccgatggggtattggatttgaacaaggcagcagaagtgctaaaagtgcaaaagagaaggatttatgatatcaccaacgttctggaaggcatccacctcattaagaagaagtctaaaaacaacgtccaatggatgggctgcagtctgtctgaggatgggggcatgctggcccagtgtcaaggcctgtcaaaagaagtgaccgagctcagtcaggaagagaagaaattagatgaactgatccaaagctgcaccctggacctcaaactgttaaccgaggattcagagaatcaaaggttagcttatgttacatatcaagatattcgaaaaattagtggccttaaagaccaaactgttatagttgtgaaagcccctccagaaacaagacttgaagtgcctgactcaatagagagcctacaaatacatttggcaagtacccaagggcccattgaggtttacttatgtccagaagagactgaaacacacagtccaatgaaaacaaacaaccaagaccacaatgggaatatccctaaacccgcttccaaagacttggcttcaaccaactcaggacatagcgattgctcagtttctatgggaaacctttctcctctggcctccccagccaacctcttacagcagactgaggaccaaattccttccaacctagaaggaccgtttgtgaacttactgcctcccctgctgcaagaggactatctcctgagcctcggggaggaggaaggcatcagcgatctcttcgatgcttacgatttggaaaagctcccactggtggaagacttcatgtgtagttgattatgcttcgtgtgaactctccttaaaaaccgatatttttttatcatggaaccagaacatctgtcatgcagtgttgtcccttcctaccttcttcctccaagagagtatcatgaagtaaactacaaacttcagaagaaagctgacattttaatgaattttttaaaaaattaataaacaaattgtctaaacgcacagttgcaggctcccttgggaaagccctgctttgctccaggctccaagatctcctggctaagtcagcaagtgagaaaatgtgcaatcaggtgtctctcaccccgaattgtccttcctccttcctccccggattggcttgctgtgcctgacggatgggctgtagaatggggtctggccacctggcctgctgggaaacagcaatcttccttaatagcatttcaagccgtgccttctccgcagaatgcatgtctttgaggtctgctaatatggaatggaactgcagcaaatgcaaacttgaagtcatgcaaaagtatgaaatggatttcttcagctcttcttaggaatatttaaattactgtcataattcagtttaagctatgaactgtgtgtcccagtaggaggtcaagaaaacctccacagccttctggatgaagaacctgttttcaaatatacttgttgcagatacagaagactagtagagttctgccactctaagctgttgtggattttcctgtctccatgaaccactcccattcccccgtccccaatgtgtttgtgagtttccagttgatttgtagcaaatgcctacttagttctttgtggattgttctagacttttaatttttttagctgccatttaagcattcctgtggcacccatcaccatttcaatttaattgtttactttgaagcggtttttgcaaattcatattacttaagcagagggagagaacctctactgatcagagcatctaaacctgtgtgatctaaggtttatcagcctctgcaaggagctttgtcccatcgtgcttccattcccaggagggggagcttggagcgagtcagtcctggggcttgctgacatgggtggcccattggaaaggagaaccaggtcagatgatgtaacagccccaaggagcagcaggcatgggtccctccatccttgggcttcccgggcccctgtgacaggggaaagggctctcttacaccgcactcagggagaccacttctcaggatggggtcagatggagagacctctagggagaaagacatccccattgtgtgagtggcatttccttaagctggcaggaacagggagcagccctgtgtcgggggctggaatagttctggccagaccccgttccccttcctctatgaaggaataagttggaccaagggaagtcggggacgtaaaaaatgaagcaaaacaatgccagggtgtctcccgctttactcttcaggaatggtgtcccaagttggaggctttgtgtcagctgcaaatcctaccagttatgtccaagaatggctttccctcgggcaggtggcagcggccatctcccactgggaatatggcgtagtatctccggtccattccttggatgctaaggactgcgggaatgagggagtcagataaagaacaaacctcgaaacgaacagttaaattgaaatgctatgtgcctgacccaatggtaggcacatagtaggcactcaactcatatgtttaattgaattgaaaatatcccttaggaaaaaaaaaaaacacacaaaaaaccacaagagccccagccagtttactccaggtagatttccacaatatgcaaagtggtggtggggtcaagacagatgacaccagcactttaaactctttgtgtgggtatgcgtgggtgtatgtttgggaagaaaaacaaaggtgcagactatcttcctttttttcttcttcagcctccatccctggcctcctcccctcacacacactggacttggtacaaaatgtcggtgtggtcctagatgaagcattggggtgggggagggagagggagctttgtgttaagtgcctactggaaatgcactgtggggttttttcctgtatgggaaaccatttatgccaagcttttccccatttcccatatttatctcatctggttagctgcctctgcttccagctttgtgtaattctctttgccagctgcacaaagctgattttttccaaagtctaaagactgagctcacctggctagattgttgtgtgttttgttgaattttttcataatgtaatgccgtatttattgtttttaaaatgaaaggaatactaataagtcttaaaagttccttcatgcataagatttttttccagttactgggtttaactggtgtacattaattagatgtccatactgtattttgtttgcattaagtaattttctttttgacttagtatccggcacacaaagtgggttagtactacagtatttgcgttactttaagtactaagtatgcaggtttcctggtaccattgagttgctgctattaaagctcacacacgaaatggctaaaagttacaagtgtgcaaattatgactgcgtgagccttagaaaataaaatgtataaagggcaacacatgagctgtcaaacagtgttaggagtgtgtttatatgtacagagttgtgcatagcaatcgttttatttaagttgatatgtagtctactcacattttcattatttagcaattttgtacaaaaatagcaattaatttgtaaacactgccagaatactttctagctgctttgtaattttttaagagtgttattttgtttttgtttttctgttctttgttgtggctcttgttttcatttttgttgtacgtgtagatctgtaaataaaattgcagtatttaaagcttaagctttcaggaaaaagaaaataagaattcagtgtgtgcatgacaactcgtgtgtatgagaaggagggatatgaaggaagatggcttgcagagtaagtcgggtggcaattgtcagggtgtgggaatttcttttcctacggggtacgtgattttgtaaaaaggaagtatttctcccaaaattgggagtaggcaaactactaatcagtttagctttgtgttgtatgctagtttaaaaaagaaaatatgtaatataatgtaaaaaaaaacaaaaaaaagcttttatgatggattttgtaaatagatttgttacagggtgacctgttctctagctgtgatcttaccacttcaaatgggtgtaatttgaataaattttgtatggtaaaggatcaataaaatgattttttttaag

SEQ ID NO: 9166 - DNA, 4094 bp, Homo sapiens
gccatttttcagctgccggccgcagcacccgggctgccgccgccgcctcgcaatccgttgcatcggccgcccccgacgcctccatccccgcttggggcccgatatccgtgcggccgggaccctcctctctccagagccccgattatttttggcccccggggcctgtgcggtgcggaaaaataaaaagaaaagagagagagggggctcggaagcgccgggcggggaggagagaaggaggagagacttggaaactccgactgcaaataataaagaaattgaaaacaatacattaatataccataacactaaaaagagcaggagcgagagatgagaaagggaatccagcccgctctggagcagtacctggtgaccgccgggggtggggagggggcggctgtcgtcgccgccgccgctgcagcctccatggacaaaagggcactgctagccagcggcggcggcggcggccctccggcaaagcgaaggctggagctaggagaaagcggtcatcagtacctctcagatggtttaaaaacccccaagggcaaaggaagagctgcactacgaagtccagatagtccaaaaaaaaaaacgcggtatgatacgtctcttggtctgctcaccaagaagttcattcagctcctgagccagtcacccgatggggtattggatttgaacaaggcagcagaagtgctaaaagtgcaaaagagaaggatttatgatatcaccaacgttctggaaggcatcagcgatctcttcgatgcttacgatttggaaaagctcccactggtggaagacttcatgtgtagttgattatgcttcgtgtgaactctccttaaaaaccgatatttttttatcatggaaccagaacatctgtcatgcagtgttgtcccttcctaccttcttcctccaagagagtatcatgaagtaaactacaaacttcagaagaaagctgacattttaatgaattttttaaaaaattaataaacaaattgtctaaacgcacagttgcaggctcccttgggaaagccctgctttgctccaggctccaagatctcctggctaagtcagcaagtgagaaaatgtgcaatcaggtgtctctcaccccgaattgtccttcctccttcctccccggattggcttgctgtgcctgacggatgggctgtagaatggggtctggccacctggcctgctgggaaacagcaatcttccttaatagcatttcaagccgtgccttctccgcagaatgcatgtctttgaggtctgctaatatggaatggaactgcagcaaatgcaaacttgaagtcatgcaaaagtatgaaatggatttcttcagctcttcttaggaatatttaaattactgtcataattcagtttaagctatgaactgtgtgtcccagtaggaggtcaagaaaacctccacagccttctggatgaagaacctgttttcaaatatacttgttgcagatacagaagactagtagagttctgccactctaagctgttgtggattttcctgtctccatgaaccactcccattcccccgtccccaatgtgtttgtgagtttccagttgatttgtagcaaatgcctacttagttctttgtggattgttctagacttttaatttttttagctgccatttaagcattcctgtggcacccatcaccatttcaatttaattgtttactttgaagcggtttttgcaaattcatattacttaagcagagggagagaacctctactgatcagagcatctaaacctgtgtgatctaaggtttatcagcctctgcaaggagctttgtcccatcgtgcttccattcccaggagggggagcttggagcgagtcagtcctggggcttgctgacatgggtggcccattggaaaggagaaccaggtcagatgatgtaacagccccaaggagcagcaggcatgggtccctccatccttgggcttcccgggcccctgtgacaggggaaagggctctcttacaccgcactcagggagaccacttctcaggatggggtcagatggagagacctctagggagaaagacatccccattgtgtgagtggcatttccttaagctggcaggaacagggagcagccctgtgtcgggggctggaatagttctggccagaccccgttccccttcctctatgaaggaataagttggaccaagggaagtcggggacgtaaaaaatgaagcaaaacaatgccagggtgtctcccgctttactcttcaggaatggtgtcccaagttggaggctttgtgtcagctgcaaatcctaccagttatgtccaagaatggctttccctcgggcaggtggcagcggccatctcccactgggaatatggcgtagtatctccggtccattccttggatgctaaggactgcgggaatgagggagtcagataaagaacaaacctcgaaacgaacagttaaattgaaatgctatgtgcctgacccaatggtaggcacatagtaggcactcaactcatatgtttaattgaattgaaaatatcccttaggaaaaaaaaaaaacacacaaaaaaccacaagagccccagccagtttactccaggtagatttccacaatatgcaaagtggtggtggggtcaagacagatgacaccagcactttaaactctttgtgtgggtatgcgtgggtgtatgtttgggaagaaaaacaaaggtgcagactatcttcctttttttcttcttcagcctccatccctggcctcctcccctcacacacactggacttggtacaaaatgtcggtgtggtcctagatgaagcattggggtgggggagggagagggagctttgtgttaagtgcctactggaaatgcactgtggggttttttcctgtatgggaaaccatttatgccaagcttttccccatttcccatatttatctcatctggttagctgcctctgcttccagctttgtgtaattctctttgccagctgcacaaagctgattttttccaaagtctaaagactgagctcacctggctagattgttgtgtgttttgttgaattttttcataatgtaatgccgtatttattgtttttaaaatgaaaggaatactaataagtcttaaaagttccttcatgcataagatttttttccagttactgggtttaactggtgtacattaattagatgtccatactgtattttgtttgcattaagtaattttctttttgacttagtatccggcacacaaagtgggttagtactacagtatttgcgttactttaagtactaagtatgcaggtttcctggtaccattgagttgctgctattaaagctcacacacgaaatggctaaaagttacaagtgtgcaaattatgactgcgtgagccttagaaaataaaatgtataaagggcaacacatgagctgtcaaacagtgttaggagtgtgtttatatgtacagagttgtgcatagcaatcgttttatttaagttgatatgtagtctactcacattttcattatttagcaattttgtacaaaaatagcaattaatttgtaaacactgccagaatactttctagctgctttgtaattttttaagagtgttattttgtttttgtttttctgttctttgttgtggctcttgttttcatttttgttgtacgtgtagatctgtaaataaaattgcagtatttaaagcttaagctttcaggaaaaagaaaataagaattcagtgtgtgcatgacaactcgtgtgtatgagaaggagggatatgaaggaagatggcttgcagagtaagtcgggtggcaattgtcagggtgtgggaatttcttttcctacggggtacgtgattttgtaaaaaggaagtatttctcccaaaattgggagtaggcaaactactaatcagtttagctttgtgttgtatgctagtttaaaaaagaaaatatgtaatataatgtaaaaaaaaacaaaaaaaagcttttatgatggattttgtaaatagatttgttacagggtgacctgttctctagctgtgatcttaccacttcaaatgggtgtaatttgaataaattttgtatggtaaaggatcaataaaatgattttttttaagagtt

SEQ ID NO: 9167 - DNA, 4145 bp, Homo sapiens
ctggtttcggaaatgcccttacagcagcaggcaaagcgaaggctggagctaggagaaagcggtcatcagtacctctcagatggtttaaaaacccccaagggcaaaggaagagctgcactacgaagtccagatagtccaaaaaaaaaaacgcggtatgatacgtctcttggtctgctcaccaagaagttcattcagctcctgagccagtcacccgatggggtattggatttgaacaaggcagcagaagtgctaaaagtgcaaaagagaaggatttatgatatcaccaacgttctggaaggcatccacctcattaagaagaagtctaaaaacaacgtccaatggatgggctgcagtctgtctgaggatgggggcatgctggcccagtgtcaaggcctgtcaaaagaagtgaccgagctcagtcaggaagagaagaaattagatgaactgatccaaagctgcaccctggacctcaaactgttaaccgaggattcagagaatcaaaggttagcttatgttacatatcaagatattcgaaaaattagtggccttaaagaccaaactgttatagttgtgaaagcccctccagaaacaagacttgaagtgcctgactcaatagagagcctacaaatacatttggcaagtacccaagggcccattgaggtttacttatgtccagaagagactgaaacacacagtccaatgaaaacaaacaaccaagaccacaatgggaatatccctaaacccgcttccaaagacttggcttcaaccaactcaggacatagcgattgctcagtttctatgggaaacctttctcctctggcctccccagccaacctcttacagcagactgaggaccaaattccttccaacctagaaggaccgtttgtgaacttactgcctcccctgctgcaagaggactatctcctgagcctcggggaggaggaaggcatcagcgatctcttcgatgcttacgatttggaaaagctcccactggtggaagacttcatgtgtagttgattatgcttcgtgtgaactctccttaaaaaccgatatttttttatcatggaaccagaacatctgtcatgcagtgttgtcccttcctaccttcttcctccaagagagtatcatgaagtaaactacaaacttcagaagaaagctgacattttaatgaattttttaaaaaattaataaacaaattgtctaaacgcacagttgcaggctcccttgggaaagccctgctttgctccaggctccaagatctcctggctaagtcagcaagtgagaaaatgtgcaatcaggtgtctctcaccccgaattgtccttcctccttcctccccggattggcttgctgtgcctgacggatgggctgtagaatggggtctggccacctggcctgctgggaaacagcaatcttccttaatagcatttcaagccgtgccttctccgcagaatgcatgtctttgaggtctgctaatatggaatggaactgcagcaaatgcaaacttgaagtcatgcaaaagtatgaaatggatttcttcagctcttcttaggaatatttaaattactgtcataattcagtttaagctatgaactgtgtgtcccagtaggaggtcaagaaaacctccacagccttctggatgaagaacctgttttcaaatatacttgttgcagatacagaagactagtagagttctgccactctaagctgttgtggattttcctgtctccatgaaccactcccattcccccgtccccaatgtgtttgtgagtttccagttgatttgtagcaaatgcctacttagttctttgtggattgttctagacttttaatttttttagctgccatttaagcattcctgtggcacccatcaccatttcaatttaattgtttactttgaagcggtttttgcaaattcatattacttaagcagagggagagaacctctactgatcagagcatctaaacctgtgtgatctaaggtttatcagcctctgcaaggagctttgtcccatcgtgcttccattcccaggagggggagcttggagcgagtcagtcctggggcttgctgacatgggtggcccattggaaaggagaaccaggtcagatgatgtaacagccccaaggagcagcaggcatgggtccctccatccttgggcttcccgggcccctgtgacaggggaaagggctctcttacaccgcactcagggagaccacttctcaggatggggtcagatggagagacctctagggagaaagacatccccattgtgtgagtggcatttccttaagctggcaggaacagggagcagccctgtgtcgggggctggaatagttctggccagaccccgttccccttcctctatgaaggaataagttggaccaagggaagtcggggacgtaaaaaatgaagcaaaacaatgccagggtgtctcccgctttactcttcaggaatggtgtcccaagttggaggctttgtgtcagctgcaaatcctaccagttatgtccaagaatggctttccctcgggcaggtggcagcggccatctcccactgggaatatggcgtagtatctccggtccattccttggatgctaaggactgcgggaatgagggagtcagataaagaacaaacctcgaaacgaacagttaaattgaaatgctatgtgcctgacccaatggtaggcacatagtaggcactcaactcatatgtttaattgaattgaaaatatcccttaggaaaaaaaaaaaacacacaaaaaaccacaagagccccagccagtttactccaggtagatttccacaatatgcaaagtggtggtggggtcaagacagatgacaccagcactttaaactctttgtgtgggtatgcgtgggtgtatgtttgggaagaaaaacaaaggtgcagactatcttcctttttttcttcttcagcctccatccctggcctcctcccctcacacacactggacttggtacaaaatgtcggtgtggtcctagatgaagcattggggtgggggagggagagggagctttgtgttaagtgcctactggaaatgcactgtggggttttttcctgtatgggaaaccatttatgccaagcttttccccatttcccatatttatctcatctggttagctgcctctgcttccagctttgtgtaattctctttgccagctgcacaaagctgattttttccaaagtctaaagactgagctcacctggctagattgttgtgtgttttgttgaattttttcataatgtaatgccgtatttattgtttttaaaatgaaaggaatactaataagtcttaaaagttccttcatgcataagatttttttccagttactgggtttaactggtgtacattaattagatgtccatactgtattttgtttgcattaagtaattttctttttgacttagtatccggcacacaaagtgggttagtactacagtatttgcgttactttaagtactaagtatgcaggtttcctggtaccattgagttgctgctattaaagctcacacacgaaatggctaaaagttacaagtgtgcaaattatgactgcgtgagccttagaaaataaaatgtataaagggcaacacatgagctgtcaaacagtgttaggagtgtgtttatatgtacagagttgtgcatagcaatcgttttatttaagttgatatgtagtctactcacattttcattatttagcaattttgtacaaaaatagcaattaatttgtaaacactgccagaatactttctagctgctttgtaattttttaagagtgttattttgtttttgtttttctgttctttgttgtggctcttgttttcatttttgttgtacgtgtagatctgtaaataaaattgcagtatttaaagcttaagctttcaggaaaaagaaaataagaattcagtgtgtgcatgacaactcgtgtgtatgagaaggagggatatgaaggaagatggcttgcagagtaagtcgggtggcaattgtcagggtgtgggaatttcttttcctacggggtacgtgattttgtaaaaaggaagtatttctcccaaaattgggagtaggcaaactactaatcagtttagctttgtgttgtatgctagtttaaaaaagaaaatatgtaatataatgt

SEQ ID NO: 9168 - DNA, 5740 bp, Homo sapiens
gttttagcggggactacgatccaggctggagttgcgctcggccggtctgagcgctggcgctgcccggacgccgcggggtccccgccagcccagggcactcggcgcggggatctgcgcgcctcgctctcccttcccgatgccgccgcccggctgctgatcgccgcaccaccttccctcatcggcttgggtccgtggaggtccctgcagaggcaggaagcctccttaggaaagcagggatggaggtaaattgtttaacactaaaagacctgatcagccccaggcagcccagactagattttgcagttgaagatggggaaaatgcacaaaaggaaaatatatttgttgatcgatcaaggatggccccgaagactccaataaaaaatgaaccaattgatttatcgaagcaaaaaaaatttactccagaaagaaatcccattactccagttaagtttgttgacagacagcaagcggaaccatggacacccacagctaacctgaagatgctcattagtgctgccagcccagatataagggaccgggagaagaaaaagggactattccgacccattgaaaacaaggacgatgcatttacagattctctacagcttgatgttgttggggacagtgctgtggacgaatttgaaaagcaaaggccaagcagaaaacagaaaagtttaggactcctgtgccagaagtttctagctcgctatccaagttatcccttgtcaactgagaaaactaccatctccctagatgaagttgctgtcagtcttggtgtggaaaggagacgcatctatgacattgtaaatgtgctggagtcgctgcatctggtcagccgggtggctaagaatcagtatggctggcatggacggcacagcctgccaaaaaccctgaggaacctccagagactaggagaggagcagaaatatgaagagcaaatggcctacctccaacagaaagagctggacctgatagattataaatttggagaacgtaaaaaagatggtgatccagattcccaggaacaacagttactggatttctctgaacccgactgtccctcttcatctgcaaacagtagaaaagacaagtctctgagaattatgagccagaagtttgtcatgctgttcctcgtctccaaaaccaagattgtcactctggatgtggctgccaaaatactgatagaagaaagccaagatgccccagaccatagtaaatttaaaacaaaggtacgacgcctctatgacatagccaatgttctgaccagcttggctctgataaagaaagtgcatgtaacagaagagcgaggtcgtaaaccagccttcaagtggatcgggcctgtggacttcagctcaagtgatgaagaactggtggatgtttctgcatctgtcttaccagaattgaaaagagaaacatatggccagattcaagtctgtgcaaaacagaagctggctcgccatggttcttttaacacagttcaggcttctgagaggatccagaggaaagtgaactcagaaccgagcagcccgtacagagaagaacaaggatcaggtggctactctttagaaattggaagcctggcagctgtctatagacagaaaatagaagacaattcacagggaaaagcctttgccagtaagagagtggtgcctccatcaagcagcttggaccctgttgctcctttccctgtcctctctgttgacccagaatattgtgttaatcctttagcccacccagtattttctgttgctcagacggacctgcaggcattctccatgcagaacggtctgaatggacaagtggatgtctcacttgcttctgcagcctctgctgtggagagcctgaagccagcactccttgctggccagcctctagtgtatgtgccctctgcctcactgttcatgctgtatggaagtctgcaggagggaccagcgtcagggtcagggtcagagagggatgacagaagctcagaagccccagccacagtagagctgtcatctgcaccctcagctcagaagcgcctctgtgaggagaggaaacctcaggaggaggatgagccagccactaaaaggcaaagtagggaatatgaagacggcccgctgtcgcttgtcatgcccaagaaaccctcagattccacagaccttgcctctcccaagactatgggtaacagggcatctatacccctcaaagacattcatgtgaatggccaactccctgctgcagaagagatttcaggaaaggcaacagcaaactctcttgtttcttctgagtggggaaatccttcaagaaatacagatgttgaaaagccttcaaaagaaaatgaaagcaccaaagagccttctttgctacaatatctttgtgtgcagtctcctgcaggattaaatggtttcaatgtacttttatctggcagtcaaaccccccctactgtgggcccgtcctcaggtcagctgccgtctttcagtgtcccttgcatggtcttaccatctccacctctgggcccttttcctgttctctattctcctgcaatgccgggcccggtttcttctactcttggtgctctcccaaacacaggacctgtgaatttcagcttgcctggccttggatcaatagcccagcttctcgtcggccccacagctgtggttaatccaaagtcgtccacactcccttctgcagaccctcagcttcagagtcagccctcactaaacctaagtccagtgatgtcaaggtcacacagtgtcgtccaacaacctgagtcccccgtttacgtgggacatccagtctcagtagtaaaattacatcagtcaccagttccagtgacccccaagagcatccaacgcacacatcgtgagacgtttttcaagacacccggcagccttggagaccctgtcctgaagagaagagaaaggaaccagtcacgaaacaccagctcggcccagaggagactagaaatccccagcggcggcgctgactaacctgccgctttgccaggtgggggtgggatcaaacgccctgagagtcccggatgtccgaggcgggatgcaaaccatcccgtcctgagcacgggtccttcctctctctttcatccacacttctgttaacttcccaccaccatcaatcatctgatttcctgaaagtaattaattgtgcatttaataccagttagagttccgactctgcatggtgtcacagtgaaagcgccgactgacttatggttttgattcaagaatcgtcttattctggaagtagatctgaataggctaccggagccttgtttttctaaaggggggcgctgtctagcacttaactagggtaagcattcttaacatgtatttccacttgccctgagtaaatctgtggtgagagaagcttcctttctgcagtttaaaaaagctactgcttccttaggcttcatcaggaagccaccttcagttgtgaatcctatggtgttatttattttgttcctgaaatgggatttagtgcaaaaagtttacaactacagtctttaacacatttttttcagggtatgacgacttgaatgtttatacttttattctataatttgccctgcacttattttacaacctagtaataatgtggataaatgtatctacatgacacatgtcaagaccaaaataactgtgaatgacacaccttgctgtaaatgaactgtgctaaccctgactgtgggcttgagaacaaagatgaactctagaactctagcagcctaactgctgcttctcaaataactgtgtgaacagtgagatattactgtttgtttctaaaaatcctactgtgcccagtttccttcactacatgccctgcattttttatttaaatatttagctgtagcgccatcagatatggatgccttctaacaattgctgtttgtaaaataaatcaggatggtagaaagtgattatatggaaaattggaacctggatgagaccttttcgttgaattctgaagagtaatgatgtgaaaattgatacagggcaagagatgattcttttgtttttcttctacttcatgtccagaagagtaagagggaaaatggacatatgtttcatatccaagggtattcaaactgtagttagttggtacctctgaaaaatgagaatggtgagcgcacgggttggttgttctagcatgaatacaattctggaaactgttatgcaatttcccttttttaacccacattactttaggggtgcattaagtcgccaaactatactagttctttgtattcctagacttgctgatatttacctctctcttgtctcttcagagtaaatggttcccttctttccttcctactttccttcattctctcttccttccctccttcctacttcttttcttccttcctcttcctctcttaaaactatcttagatgtagaatcctggtgtagggttttattttatttttattttttgacccaataaaatgttatatgaaagaatgaaaatattaatttaagagactctgggagtctgaataaagtagctttatattaactacaggataatattagccttattacccccacaagattttttaaaacttgaggtaggtagctacattaaataaatttgctacttatataaaaatttttatcaacactaaacttttaaagtttacaagttttttttttcttttttacagtcttctatagagttaggttaaaaatgtggttctaaccatcaacaattgcatggttaaatgaccctgaactaaaactgatgggttccctatcaaaacaaataaaaatatacctttttcaggtttcaatctgtgcagggtatatgcatgttaattctaccatgcttaagaacttccacaaaatatttcatggagaggtctgcatttagacggaaacagaaattgcttttcccctcactgttcctgaatgctctatacttgttttaacatttttgctatctttttttattattctgatcatgatatgaccatttaacctcagaattcataattcctgaggggtgttaagaagcagtcccattggtgaggatattatgacttggtgaccattcttaggagtagaaaaccaaggacaattgcttctgtattcagtatccacttcttaatgtggctttatatgtaaaaataataatgcagtggttgtttctgtcaggaaaataaatcttacagaacaactggtggaattgaagctgctgcgctagacttggatattttgggtagtgaagaagcaatggcaatcttgagtctattattgtataatttagtaaaagaaaaaaataatcgttggtggtcctactaagagaatgcagcttttttgagttgtcacagaggctgtgtgtgccctacactgaccagggtttgtaaaaccctttcattctggtacaagagtcgggggtataacttttatacttgaatctacctaccaagtttacatttctcaattcctttttgtaaggtgctatttctgtatttaaataactttcttttaacgtaaagctgctttctgcttatcttattgcactgctagttgtatgtaggtattaattttattgctgcttactgcttttgttttcttattatttagctctgctctttttcctaatggctatattatctatagctatttacttgtaactgtactacatgtaaactgattttttgttctgattttttttctaatatttttaggaaaatattaagctttataaaatagcaataaaaaataattcatttaagaag

SEQ ID NO: 9169 - DNA, 3949 bp, Homo sapiens
ctgttgctcagacggacctgcaggcattctccatgcagaacggtctgaatggacaagtggatgtctcacttgcttctgcagcctctgctgtggagagcctgaagccagcactccttgctggccagcctctagtgtatgtgccctctgcctcactgttcatgctgtatggaagtctgcaggagggaccagcgtcagggtcagggtcagagagggatgacagaagctcagaagccccagccacagtagagctgtcatctgcaccctcagctcagaagcgcctctgtgaggagaggaaacctcaggaggaggatgagccagccactaaaaggcaaagtagggaatatgaagacggcccgctgtcgcttgtcatgcccaagaaaccctcagattccacagaccttgcctctcccaagactatgggtaacagggcatctatacccctcaaagacattcatgtgaatggccaactccctgctgcagaagagatttcaggaaaggcaacagcaaactctcttgtttcttctgagtggggaaatccttcaagaaatacagatgttgaaaagccttcaaaagaaaatgaaagcaccaaagagccttctttgctacaatatctttgtgtgcagtctcctgcaggattaaatggtttcaatgtacttttatctggcagtcaaaccccccctactgtgggcccgtcctcaggtcagctgccgtctttcagtgtcccttgcatggtcttaccatctccacctctgggcccttttcctgttctctattctcctgcaatgccgggcccggtttcttctactcttggatcaatagcccagcttctcgtcggccccacagctgtggttaatccaaagtcgtccacactcccttctgcagaccctcagcttcagagtcagccctcactaaacctaagtccagtgatgtcaaggtcacacagtgtcgtccaacaacctgagtcccccgtttacgtgggacatccagtctcagtagtaaaattacatcagtcaccagttccagtgacccccaagagcatccaacgcacacatcgtgagacgtttttcaagacacccggcagccttggagaccctgtcctgaagagaagagaaaggaaccagtcacgaaacaccagctcggcccagaggagactagaaatccccagcggcggcgctgactaacctgccgctttgccaggtgggggtgggatcaaacgccctgagagtcccggatgtccgaggcgggatgcaaaccatcccgtcctgagcacgggtccttcctctctctttcatccacacttctgttaacttcccaccaccatcaatcatctgatttcctgaaagtaattaattgtgcatttaataccagttagagttccgactctgcatggtgtcacagtgaaagcgccgactgacttatggttttgattcaagaatcgtcttattctggaagtagatctgaataggctaccggagccttgtttttctaaaggggggcgctgtctagcacttaactagggtaagcattcttaacatgtatttccacttgccctgagtaaatctgtggtgagagaagcttcctttctgcagtttaaaaaagctactgcttccttaggcttcatcaggaagccaccttcagttgtgaatcctatggtgttatttattttgttcctgaaatgggatttagtgcaaaaagtttacaactacagtctttaacacatttttttcagggtatgacgacttgaatgtttatacttttattctataatttgccctgcacttattttacaacctagtaataatgtggataaatgtatctacatgacacatgtcaagaccaaaataactgtgaatgacacaccttgctgtaaatgaactgtgctaaccctgactgtgggcttgagaacaaagatgaactctagaactctagcagcctaactgctgcttctcaaataactgtgtgaacagtgagatattactgtttgtttctaaaaatcctactgtgcccagtttccttcactacatgccctgcattttttatttaaatatttagctgtagcgccatcagatatggatgccttctaacaattgctgtttgtaaaataaatcaggatggtagaaagtgattatatggaaaattggaacctggatgagaccttttcgttgaattctgaagagtaatgatgtgaaaattgatacagggcaagagatgattcttttgtttttcttctacttcatgtccagaagagtaagagggaaaatggacatatgtttcatatccaagggtattcaaactgtagttagttggtacctctgaaaaatgagaatggtgagcgcacgggttggttgttctagcatgaatacaattctggaaactgttatgcaatttcccttttttaacccacattactttaggggtgcattaagtcgccaaactatactagttctttgtattcctagacttgctgatatttacctctctcttgtctcttcagagtaaatggttcccttctttccttcctactttccttcattctctcttccttccctccttcctacttcttttcttccttcctcttcctctcttaaaactatcttagatgtagaatcctggtgtagggttttattttatttttattttttgacccaataaaatgttatatgaaagaatgaaaatattaatttaagagactctgggagtctgaataaagtagctttatattaactacaggataatattagccttattacccccacaagattttttaaaacttgaggtaggtagctacattaaataaatttgctacttatataaaaatttttatcaacactaaacttttaaagtttacaagttttttttttcttttttacagtcttctatagagttaggttaaaaatgtggttctaaccatcaacaattgcatggttaaatgaccctgaactaaaactgatgggttccctatcaaaacaaataaaaatatacctttttcaggtttcaatctgtgcagggtatatgcatgttaattctaccatgcttaagaacttccacaaaatatttcatggagaggtctgcatttagacggaaacagaaattgcttttcccctcactgttcctgaatgctctatacttgttttaacatttttgctatctttttttattattctgatcatgatatgaccatttaacctcagaattcataattcctgaggggtgttaagaagcagtcccattggtgaggatattatgacttggtgaccattcttaggagtagaaaaccaaggacaattgcttctgtattcagtatccacttcttaatgtggctttatatgtaaaaataataatgcagtggttgtttctgtcaggaaaataaatcttacagaacaactggtggaattgaagctgctgcgctagacttggatattttgggtagtgaagaagcaatggcaatcttgagtctattattgtataatttagtaaaagaaaaaaataatcgttggtggtcctactaagagaatgcagcttttttgagttgtcacagaggctgtgtgtgccctacactgaccagggtttgtaaaaccctttcattctggtacaagagtcgggggtataacttttatacttgaatctacctaccaagtttacatttctcaattcctttttgtaaggtgctatttctgtatttaaataactttcttttaacgtaaagctgctttctgcttatcttattgcactgctagttgtatgtaggtattaattttattgctgcttactgcttttgttttcttattatttagctctgctctttttcctaatggctatattatctatagctatttacttgtaactgtactacatgtaaactgattttttgttctgattttttttctaatatttttaggaaaatattaagctttataaaatagcaataaaaaataattcatttaagaag

SEQ ID NO: 9170 - DNA, 5297 bp, Homo sapiens
gatccaggctggagttgcgctcggccggtctgagcgctggcgctgcccggacgccgcggggtccccgccagcccagggcactcggcgcggggatctgcgcgcctcgctctcccttcccgatgccgccgcccggctgctgatcgccgcaccaccttccctcatcggcttgggtccgtggaggtccctgcagaggcaggaagcctccttaggaaagcagggatggaggtaaattgtttaacactaaaagacctgatcagccccaggcagcccagactagattttgcagttgaagatggggaaaatgcacaaaaggaaaatatatttgttgatcgatcaaggatggccccgaagactccaataaaaaatgaaccaattgatttatcgaagcaaaaaaaatttactccagaaagaaatcccattactccagttaagtttgttgacagacagcaagcggaaccatggacacccacagctaacctgaagatgctcattagtgctgccagcccagatataagggaccgggagaagaaaaagggactattccgacccattgaaaacaaggacgatgcatttacagattctctacagcttgatgttgttggggacagtgctgtggacgaatttgaaaagcaaaggccaagcagaaaacagaaaagtttaggactcctgtgccagaagtttctagctcgctatccaagttatcccttgtcaactgagaaaactaccatctccctagatgaagttgctgtcagtcttggtgtggaaaggagacgcatctatgacattgtaaatgtgctggagtcgctgcatctggtcagccgggtggctaagaatcagtatggctggcatggacggcacagcctgccaaaaaccctgaggaacctccagagactaggagaggagcagaaatatgaagagcaaatggcctacctccaacagaaagagctggacctgatagattataaatttggagaacgtaaaaaagatggtgatccagattcccaggaacaacagttactggatttctctgaacccgactgtccctcttcatctgcaaacagtagaaaagacaagtctctgagaattatgagccagaagtttgtcatgctgttcctcgtctccaaaaccaagattgtcactctggatgtggctgccaaaatactgatagaagaaagccaagatgccccagaccatagtaaatttaaaacaaaggtacgacgcctctatgacatagccaatgttctgaccagcttggctctgataaagaaagtgcatgtaacagaagagcgaggtcgtaaaccagccttcaagtggatcgggcctgtggacttcagctcaagtgatgaagaactggtggatgtttctgcatctgtcttaccagaattgaaaagagaaacatatggccagattcaagtctgtgcaaaacagaagctggctcgccatggttcttttaacacagttcaggcttctgagaggatccagaggaaagtgaactcagaaccgagcagcccgtacagagaagaacaaggatcaggtggctactctttagaaattggaagcctggcagctgtctatagacagaaaatagaagacaattcacagggaaaagcctttgccagtaagagagtggtgcctccatcaagcagcttggaccctgttgctcctttccctgtcctctctgttgacccagaatattgtgttaatcctttagcccacccagtattttctgttgctcagacggacctgcaggcattctccatgcagaacggtctgaatggacaagtggatgtctcacttgcttctgcagcctctgctgtggagagcctgaagccagcactccttgctggccagcctctagtgtatgtgccctctgcctcactgttcatgctgtatggaagtctgcaggagggaccagcgtcagggtcagggtcagagagggatgacagaagctcagaagccccagccacagtagagctgtcatctgcaccctcagctcagaagcgcctctgtgaggagaggaaacctcaggaggaggatgagccagccactaaaaggcaaagtagggaatatgaagacggcccgctgtcgcttgtcatgcccaagaaaccctcagattccacagaccttgcctctcccaagactatgggtaacagggcatctatacccctcaaagacattcatgtgaatggccaactccctgctgcagaagagatttcaggaaaggcaacagcaaactctcttgtttcttctgagtggggaaatccttcaagaaatacagatgttgaaaagccttcaaaagaaaatgaaagcaccaaagagccttctttgctacaatatctttgtgtgcagtctcctgcagtcaccagttccagtgacccccaagagcatccaacgcacacatcgtgagacgtttttcaagacacccggcagccttggagaccctgtcctgaagagaagagaaaggaaccagtcacgaaacaccagctcggcccagaggagactagaaatccccagcggcggcgctgactaacctgccgctttgccaggtgggggtgggatcaaacgccctgagagtcccggatgtccgaggcgggatgcaaaccatcccgtcctgagcacgggtccttcctctctctttcatccacacttctgttaacttcccaccaccatcaatcatctgatttcctgaaagtaattaattgtgcatttaataccagttagagttccgactctgcatggtgtcacagtgaaagcgccgactgacttatggttttgattcaagaatcgtcttattctggaagtagatctgaataggctaccggagccttgtttttctaaaggggggcgctgtctagcacttaactagggtaagcattcttaacatgtatttccacttgccctgagtaaatctgtggtgagagaagcttcctttctgcagtttaaaaaagctactgcttccttaggcttcatcaggaagccaccttcagttgtgaatcctatggtgttatttattttgttcctgaaatgggatttagtgcaaaaagtttacaactacagtctttaacacatttttttcagggtatgacgacttgaatgtttatacttttattctataatttgccctgcacttattttacaacctagtaataatgtggataaatgtatctacatgacacatgtcaagaccaaaataactgtgaatgacacaccttgctgtaaatgaactgtgctaaccctgactgtgggcttgagaacaaagatgaactctagaactctagcagcctaactgctgcttctcaaataactgtgtgaacagtgagatattactgtttgtttctaaaaatcctactgtgcccagtttccttcactacatgccctgcattttttatttaaatatttagctgtagcgccatcagatatggatgccttctaacaattgctgtttgtaaaataaatcaggatggtagaaagtgattatatggaaaattggaacctggatgagaccttttcgttgaattctgaagagtaatgatgtgaaaattgatacagggcaagagatgattcttttgtttttcttctacttcatgtccagaagagtaagagggaaaatggacatatgtttcatatccaagggtattcaaactgtagttagttggtacctctgaaaaatgagaatggtgagcgcacgggttggttgttctagcatgaatacaattctggaaactgttatgcaatttcccttttttaacccacattactttaggggtgcattaagtcgccaaactatactagttctttgtattcctagacttgctgatatttacctctctcttgtctcttcagagtaaatggttcccttctttccttcctactttccttcattctctcttccttccctccttcctacttcttttcttccttcctcttcctctcttaaaactatcttagatgtagaatcctggtgtagggttttattttatttttattttttgacccaataaaatgttatatgaaagaatgaaaatattaatttaagagactctgggagtctgaataaagtagctttatattaactacaggataatattagccttattacccccacaagattttttaaaacttgaggtaggtagctacattaaataaatttgctacttatataaaaatttttatcaacactaaacttttaaagtttacaagttttttttttcttttttacagtcttctatagagttaggttaaaaatgtggttctaaccatcaacaattgcatggttaaatgaccctgaactaaaactgatgggttccctatcaaaacaaataaaaatatacctttttcaggtttcaatctgtgcagggtatatgcatgttaattctaccatgcttaagaacttccacaaaatatttcatggagaggtctgcatttagacggaaacagaaattgcttttcccctcactgttcctgaatgctctatacttgttttaacatttttgctatctttttttattattctgatcatgatatgaccatttaacctcagaattcataattcctgaggggtgttaagaagcagtcccattggtgaggatattatgacttggtgaccattcttaggagtagaaaaccaaggacaattgcttctgtattcagtatccacttcttaatgtggctttatatgtaaaaataataatgcagtggttgtttctgtcaggaaaataaatcttacagaacaactggtggaattgaagctgctgcgctagacttggatattttgggtagtgaagaagcaatggcaatcttgagtctattattgtataatttagtaaaagaaaaaaataatcgttggtggtcctactaagagaatgcagcttttttgagttgtcacagaggctgtgtgtgccctacactgaccagggtttgtaaaaccctttcattctggtacaagagtcgggggtataacttttatacttgaatctacctaccaagtttacatttctcaattcctttttgtaaggtgctatttctgtatttaaataactttcttttaacgtaaagctgctttctgcttatcttattgcactgctagttgtatgtaggtattaattttattgctgcttactgcttttgttttcttattatttagctctgctctttttcctaatggctatattatctatagctatttacttgtaactgtactacatgtaaactgattttttgttctgattttttttctaatatttttaggaaaatattaagctttataaaatagcaataaaaaataattcatttaagaa

SEQ ID NO: 9171 - DNA, 570 bp, Homo sapiens
gttgcgctcggccggtctgagcgctggcgctgcccggacgccgcggggtccccgccagcccagggcactcggcgcggggatctgcgcgcctcgctctcccttcccgatgccgccgcccggctgctgatcgccgcaccaccttccctcatcggcttgggtccgtggaggtccctgcagaggcaggaagcctccttaggaaagcagggtgtaattgtgcattacagatggaggtaaattgtttaacactaaaagacctgatcagccccaggcagcccagactagattttgcagttgaagatggggaaaatgcacaaaaggaaaatatatttgttgatcgatcaaggatggccccgaagactccaataaaaaatgaaccaattgatttatcgaagcaaaaaaaatttactccagaaagaaatcccattactccagttaagtttgttgacagacagcaagcggaaccatggacacccacagctaacctgaagatgctcattagtgctgccagcccagatataagggaccgggagaagaaaaagggactattccgacccattgaaaacaaggacg

SEQ ID NO: 9172 - DNA, 3240 bp, Homo sapiens
aagtgcactgagcgagtggcggccgggggacagtacctgcttgccttattgggcaaatacagccttccaaggtggagtctaacgccgtggtgtgaactggccacccgaacagggagtaaatagtgctttgtatctttaaggaagcccttttttaaatttaaaaaaaaagtcttaattataagactctttaaatgcccaactgcatacttggagctttgggactgaatttggaactttcctgtcaagcgacctcccacgactttactgctgagcctgtgcacgtgtgtgtaaggggagaaatccaggcatctagatgcagacttgtacccagttacttggggtcgcgtgcgctcagctgggacctgggctcgtgcgcttagtccggagccctgatctgcgaacaggatattaaaacttttagtacaattgattggactacttgaaccatcgggatttggggaggaactccagatttttcatttttaaactctaaatgtatgaggaatttacagaatggagaacgaaaaggaaaatctcttttgtgagccacataaaaggggactaatgaaaacacctctgaaagaatccaccacagcaaatatcgtgttggcagagatccagcctgactttggccctttaaccacacctaccaagcccaaggaaggctctcagggagagccgtggacaccgacagccaacctgaaaatgctcatcagtgctgtgagccctgagatccgcaacagagatcagaaaaggggtttgtttgacaacagaagtggattacctgaggccaaagactgtatacacgaacacttatctggagatgaatttgagaaatcccaaccaagtcgaaaagagaaaagtttaggattattgtgtcataagttcttagcacgatatcctaattatcccaaccctgctgtgaataatgacatctgccttgacgaagtggcagaggaacttaatgttgaacgtcgacgcatttacgatatcgtgaacgtcctagagagtttacatatggtgagccgcctcgccaaaaacaggtacacttggcacgggcgacacaatctcaacaaaacccttggcaccttgaagagcatcggggaggagaataagtacgccgagcagattatgatgatcaaaaagaaagaatatgagcaagagtttgactttattaagagttacagtatagaggatcatatcatcaaatcaaacactggcccaaatggacacccagacatgtgttttgtggaactccctggagtggaatttcgggcagcttctgtaaacagccgcaaagacaagtctttaagggtaatgagccagaaatttgtgatgctgtttttggtgtcaacgcctcagatagtaagcctagaagttgctgccaagattttaattggggaggaccatgtggaagatttggataaaagcaagtttaaaacaaaaattaggaggttgtatgatatagctaatgttctgagtagcctggatcttatcaagaaagttcatgttacagaggaaagaggccgaaaaccagctttcaaatggaccggcccagaaatcagtccaaataccagtggctccagcccagtcattcattttactccctctgatttggaggtgagacggtcttcaaaagagaactgtgccaaaaacctcttttccacacgtgggaaaccaaactttactcgacacccatctcttatcaaattggtaaagagtatagaaagtgatcggagaaagataaattctgcgcccagtagccctatcaagaccaacaaagctgagagttctcagaattctgcacccttcccaagtaaaatggctcagctcgcagctatttgtaaaatgcagttagaagagcaatcaagtgaatccagacagaaagtgaaagtacagctggcaagatctggaccctgcaaaccagtagcccctctggaccccccagtgaatgctgagatggagctgacagcaccgtccctcatccagcccctgggaatggttcccctgatccccagccccttgtcatcagcagtgcccctgatcctacctcaggccccttcaggcccatcctatgccatctacctgcagcccactcaagcccaccaaagtgtgacgccaccccaaggcctgagcccaacggtgtgcaccacccactcttctaaagctactggctcaaaagactccacagatgccaccactgagaaggcagccaatgatacctcaaaggccagtgcctctaccaggcctggaagcttgctgccagcaccagagaggcaaggggcaaagagccgaaccagggagccagctggagaaagaggctcaaagagggcaagcatgctcgaggacagtggttccaaaaagaaatttaaagaggacctaaaaggacttgaaaatgtctccgcaaccttgttcccatcaggatacctaatccctctcacgcagtgctcatccctgggggcagagtccattttgtctggtaaagaaaactcaagtgctctttccccaaaccacaggatttacagctccccaattgcaggtgttattccagtgacatcatctgaactcactgctgttaattttccctcttttcatgtaacaccgttgaagctaatggtctcaccaacttccgtggcagccgtacctgtcgggaacagcccggctctcgcttcaagccaccctgttcccatccagaacccaagctcagccattgtaaacttcaccctgcagcacctgggactcatctcacccaatgtgcagttgtctgccagccctgggtctggaatcgttcctgtgtctccaagaatagagtctgttaatgtcgcaccagaaaatgcaggcactcagcaaggaagggccaccaactatgactcaccagtcccaggccagagccagccaaatggacaatcagttgctgtgacaggggcacaacagcctgttcctgtgacacccaaagggtcacaattagtggccgaaagtttcttccgtaccccaggtggacccaccaagccaaccagctcatcctgcatggattttgagggtgctaataaaacctccttaggaactctctttgtcccacagcgaaaactggaagtctcaacagaggatgtccattaatcaacagatgttggcttagtttaattttctaaagagttgtttaatagagaaaatgtacacagactgatttggagaacacattctctgaaaatactgtaaatacgttggggatttgttcaatgt

SEQ ID NO: 9173 - DNA, 3191 bp, Homo sapiens
atgcaaaaaaaaaaagaaaatctcttttgtgagccacataaaaggggactaatgaaaacacctctgaaagaatccaccacagcaaatatcgtgttggcagagatccagcctgactttggccctttaaccacacctaccaagcccaaggaaggctctcagggagagccgtggacaccgacagccaacctgaaaatgctcatcagtgctgtgagccctgagatccgcaacagagatcagaaaaggggtttgtttgacaacagaagtggattacctgaggccaaagactgtatacacgaacacttatctggagatgaatttgagaaatcccaaccaagtcgaaaagagaaaagtttaggattattgtgtcataagttcttagcacgatatcctaattatcccaaccctgctgtgaataatgacatctgccttgacgaagtggcagaggaacttaatgttgaacgtcgacgcatttacgatatcgtgaacgtcctagagagtttacatatggtgagccgcctcgccaaaaacaggtacacttggcacgggcgacacaatctcaacaaaacccttggcaccttgaagagcatcggggaggagaataagtacgccgagcagattatgatgatcaaaaagaaagaatatgagcaagagtttgactttattaagagttacagtatagaggatcatatcatcaaatcaaacactggcccaaatggacacccagacatgtgttttgtggaactccctggagtggaatttcgggcagcttctgtaaacagccgcaaagacaagtctttaagggtaatgagccagaaatttgtgatgctgtttttggtgtcaacgcctcagatagtaagcctagaagttgctgccaagattttaattggggaggaccatgtggaagatttggataaaagcaagtttaaaacaaaaattaggaggttgtatgatatagctaatgttctgagtagcctggatcttatcaagaaagttcatgttacagaggaaagaggccgaaaaccagctttcaaatggaccggcccagaaatcagtccaaataccagtggctccagcccagtcattcattttactccctctgatttggaggtgagacggtcttcaaaagagaactgtgccaaaaacctcttttccacacgtgggaaaccaaactttactcgacacccatctcttatcaaattggtaaagagtatagaaagtgatcggagaaagataaattctgcgcccagtagccctatcaagaccaacaaagctgagagttctcagaattctgcacccttcccaagtaaaatggctcagctcgcagctatttgtaaaatgcagttagaagagcaatcaagtgaatccagacagaaagtgaaagtacagctggcaagatctggaccctgcaaaccagtagcccctctggaccccccagtgaatgctgagatggagctgacagcaccgtccctcatccagcccctgggaatggttcccctgatccccagccccttgtcatcagcagtgcccctgatcctacctcaggccccttcaggcccatcctatgccatctacctgcagcccactcaagcccaccaaagtgtgacgccaccccaaggcctgagcccaacggtgtgcaccacccactcttctaaagctactggctcaaaagactccacagatgccaccactgagaaggcagccaatgatacctcaaaggccagtgcctctaccaggcctggaagcttgctgccagcaccagagaggcaaggggcaaagagccgaaccagggagccagctggagaaagaggctcaaagagggcaagcatgctcgaggacagtggttccaaaaagaaatttaaagaggacctaaaaggacttgaaaatgtctccgcaaccttgttcccatcaggatacctaatccctctcacgcagtgctcatccctgggggcagagtccattttgtctggtaaagaaaactcaagtgctctttccccaaaccacaggatttacagctccccaattgcaggtgttattccagtgacatcatctgaactcactgctgttaattttccctcttttcatgtaacaccgttgaagctaatggtctcaccaacttccgtggcagccgtacctgtcgggaacagcccggctctcgcttcaagccaccctgttcccatccagaacccaagctcagccattgtaaacttcaccctgcagcacctgggactcatctcacccaatgtgcagttgtctgccagccctgggtctggaatcgttcctgtgtctccaagaatagagtctgttaatgtcgcaccagaaaatgcaggcactcagcaaggaagggccaccaactatgactcaccagtcccaggccagagccagccaaatggacaatcagttgctgtgacaggggcacaacagcctgttcctgtgacacccaaagggtcacaattagtggccgaaagtttcttccgtaccccaggtggacccaccaagccaaccagctcatcctgcatggattttgagggtgctaataaaacctccttaggaactctctttgtcccacagcgaaaactggaagtctcaacagaggatgtccattaatcaacagatgttggcttagtttaattttctaaagagttgtttaatagagaaaatgtacacagactgatttggagaacacattctctgaaaatactgtaaatacgttggggatttgttcaatgtgaaatcagatagttgttttcatacatatatatatatacacacacacacacacacacacacacacatatatttgtataaagctaagtttagctttcaatcctacaaaataaaagtaaaatgttgaactctaagatatattaacttctagggggaaaaatccattattttagctatgcctatactattatgcaaagtaactgtattaaagtttacttccctctaagcaaatatgcttgacatgcctaacacagcattcccttaaacattttgcacaaagaaaatgctgtgtgatgtataatgttgtatttttaaataggggtatagctatattttttgtaatttctttaatctgttgttgcagtgtatctttttgtaaagtttgcaacaatcctcaatcaagtctatggaaaaattatttataaaatgtatttttaatcataagttgttcaaattaaaacttttct

SEQ ID NO: 9174 - DNA, 3432 bp, Homo sapiens
aaatcgggggcttggctgctcctggacggtcacgctccctctgcccgccagccggcccgccagtcccggtcccggcgtctctctccggcacccacctcggcgctgcggaaagactgactgccaggatattaaaacttttagtacaattgattggactacttgaaccatcgggatttggggaggaactccagatttttcatttttaaactctaaatgtatgaggaatttacagaatggagaacgaaaaggaaaatctcttttgtgagccacataaaaggggactaatgaaaacacctctgaaagaatccaccacagcaaatatcgtgttggcagagatccagcctgactttggccctttaaccacacctaccaagcccaaggaaggctctcagggagagccgtggacaccgacagccaacctgaaaatgctcatcagtgctgtgagccctgagatccgcaacagagatcagaaaaggggtttgtttgacaacagaagtggattacctgaggccaaagactgtatacacgaacacttatctggagatgaatttgagaaatcccaaccaagtcgaaaagagaaaagtttaggattattgtgtcataagttcttagcacgatatcctaattatcccaaccctgctgtgaataatgacatctgccttgacgaagtggcagaggaacttaatgttgaacgtcgacgcatttacgatatcgtgaacgtcctagagagtttacatatggtgagccgcctcgccaaaaacaggtacacttggcacgggcgacacaatctcaacaaaacccttggcaccttgaagagcatcggggaggagaataagtacgccgagcagattatgatgatcaaaaagaaagaatatgagcaagagtttgactttattaagagttacagtatagaggatcatatcatcaaatcaaacactggcccaaatggacacccagacatgtgttttgtggaactccctggagtggaatttcgggcagcttctgtaaacagccgcaaagacaagtctttaagggtaatgagccagaaatttgtgatgctgtttttggtgtcaacgcctcagatagtaagcctagaagttgctgccaagattttaattggggaggaccatgtggaagatttggataaaagcaagtttaaaacaaaaattaggaggttgtatgatatagctaatgttctgagtagcctggatcttatcaagaaagttcatgttacagaggaaagaggccgaaaaccagctttcaaatggaccggcccagaaatcagtccaaataccagtggctccagcccagtcattcattttactccctctgatttggaggtgagacggtcttcaaaagagaactgtgccaaaaacctcttttccacacgtgggaaaccaaactttactcgacacccatctcttatcaaattggtaaagagtatagaaagtgatcggagaaagataaattctgcgcccagtagccctatcaagaccaacaaagctgagagttctcagaattctgcacccttcccaagtaaaatggctcagctcgcagctatttgtaaaatgcagttagaagagcaatcaagtgaatccagacagaaagtgaaagtacagctggcaagatctggaccctgcaaaccagtagcccctctggaccccccagtgaatgctgagatggagctgacagcaccgtccctcatccagcccctgggaatggttcccctgatccccagccccttgtcatcagcagtgcccctgatcctacctcaggccccttcaggcccatcctatgccatctacctgcagcccactcaagcccaccaaagtgtgacgccaccccaaggcctgagcccaacggtgtgcaccacccactcttctaaagctactggctcaaaagactccacagatgccaccactgagaaggcagccaatgatacctcaaaggccagtgcctctaccaggcctggaagcttgctgccagcaccagagaggcaaggggcaaagagccgaaccagggagccagctggagaaagaggctcaaagagggcaagcatgctcgaggacagtggttccaaaaagaaatttaaagaggacctaaaaggacttgaaaatgtctccgcaaccttgttcccatcaggatacctaatccctctcacgcagtgctcatccctgggggcagagtccattttgtctggtaaagaaaactcaagtgctctttccccaaaccacaggatttacagctccccaattgcaggtgttattccagtgacatcatctgaactcactgctgttaattttccctcttttcatgtaacaccgttgaagctaatggtctcaccaacttccgtggcagccgtacctgtcgggaacagcccggctctcgcttcaagccaccctgttcccatccagaacccaagctcagccattgtaaacttcaccctgcagcacctgggactcatctcacccaatgtgcagttgtctgccagccctgggtctggaatcgttcctgtgtctccaagaatagagtctgttaatgtcgcaccagaaaatgcaggcactcagcaaggaagggccaccaactatgactcaccagtcccaggccagagccagccaaatggacaatcagttgctgtgacaggggcacaacagcctgttcctgtgacacccaaagggtcacaattagtggccgaaagtttcttccgtaccccaggtggacccaccaagccaaccagctcatcctgcatggattttgagggtgctaataaaacctccttaggaactctctttgtcccacagcgaaaactggaagtctcaacagaggatgtccattaatcaacagatgttggcttagtttaattttctaaagagttgtttaatagagaaaatgtacacagactgatttggagaacacattctctgaaaatactgtaaatacgttggggatttgttcaatgtgaaatcagatagttgttttcatacatatatatatatacacacacacacacacacacacacacacatatatttgtataaagctaagtttagctttcaatcctacaaaataaaagtaaaatgttgaactctaagatatattaacttctagggggaaaaatccattattttagctatgcctatactattatgcaaagtaactgtattaaagtttacttccctctaagcaaatatgcttgacatgcctaacacagcattcccttaaacattttgcacaaagaaaatgctgtgtgatgtataatgttgtatttttaaataggggtatagctatattttttgtaatttctttaatctgttgttgcagtgtatctttttgtaaagtttgcaacaatcctcaatcaagtctatggaaaaattatttataaaatgtatttttaatcataagttgttcaaattaaaacttttctaaaatata

SEQ ID NO: 9175 - DNA, 2573 bp, Homo sapiens
atgacgacatggtcgtaaatccgccatcttcctgcggcgcgttgcgacatggagggcgcgatggcagtgcgggtgacggccgctcatacggcagaagcccaggccgaagccgggcgggaagcgggcgagggtgcagttgcggcggtggcggcggccttggcccccagcggcttcctcggcctcccggcgcccttcagcgaggaagatgaggacgatgtgcacagatgcggccgctgccaggcagagttcaccgccttggaggattttgttcagcacaagattcagaaggcctgccagcgggcccctccggaggccctgcctgccacccctgccaccacagcgttgctgggccaggaggtggtgccggcagcaccaggcccagaggagcccatcactgtggcccacatcgtggtggaggcggcctctctggcagcagacatcagccacgcatctgaccttgttggtggtgggcacatcaaagaggtcatcgtggctgctgaggcggagctgggagacggtgagatggccgaggccccgggcagcccccgccagcaggggctggggctcgcaggggagggtgagcaggcccaggtgaagctactggtgaacaaggatggccgctatgtgtgtgcgctgtgccacaagaccttcaagacgggcagcatcctcaaggcccacatggtcactcacagcagccgcaaggaccacgagtgcaagctctgtggggcctccttccgcaccaagggctcactcatccggcaccaccggcggcacacggatgagcgcccctacaagtgctccaagtgtggaaagagcttccgggagtcgggtgcactgacccggcacctcaagtctctcaccccctgcacagagaaaatccgcttcagtgtgagcaaggacgtggttgtcagcaaagaggacgcacgtgcaggttctggagctggagctgccggcttggggacagccacatcatcggtgacaggcgagcctatagagacttcacccgtgattcacctggtgacagatgccaagggcaccgtcatccacgaagtccacgtccagatgcaggagctgtccctgggcatgaaagccctggccccagagccccccgtctcccaggagctcccctgctccagcgagggcagccgtgagaacctgctgcaccaggccatgcagaactccggcatcgtccttgagcgcgctgctggggaggagggtgccctggagccagctcctgctgccgggtccagtccccagcccctggcagtggcagccccgcagctgccggtactggaagtgcagccgctggagacacaggtggccagcgaggcctcagcggtgcccaggacccacccatgtcctcagtgcagtgagaccttcccgacagcagccaccctggaggcccacaagaggggccacaccgggccgaggccgttcgcctgcgcgcagtgtggcaaggccttccccaaggcctacctgctcaagaagcaccaggaggtgcacgtgcgtgagcgccgcttccgctgtggcgactgcgggaagctctacaagaccattgcccatgtgcgtggccaccggcgcgtccactcagacgagcggccctacccttgtcccaagtgtggcaagcgctacaagactaagaacgcacagcaggtgcacttcaggacacacctggaggagaagccgcacgtgtgccagttctgcagccgtggcttccgagagaagggctcactggtgcggcacgtgcgacaccacacaggcgagaagccgttcaagtgctacaagtgcggccgtggcttcgccgagcacggcacgctgaaccggcacctgcgcaccaaagggggctgcctgctggaggtggaggagttgctggtgtctgaggacagccccgcggcagccaccaccgtcctcacggaagacccgcacacagtgttggtggagttctcgtccgtggtagctgacacccaggagtatatcatcgaggccactgcggacgatgcggagaccagtgaggccacggagatcatcgagggcacccagacagaggtggacagccacatcatgaaggtggtgcagcagatcgtgcaccaggctagcgccggccaccagatcatcgtgcagaacgtcaccatggacgaggagacggcgctgggcccagaggcggctgccgccgacaccatcaccatcgccacccccgagagcctgacagagcaggtggccatgacgctggcctcggccatcagcgagggcactgtgcttgccgcccgggcagggacaagtggcactgaacaggccactgtgaccatggtgtcatcagaggacatcgagatcctggagcatgcaggcgagctggtcatcgcctcgccggagggccagctggaggtgcagacggtcatcgtctagcatgaggtctgcggggtcctggccgggcagggacagggcagaggactctgagcgccccacccatgcctgcctggcctggtagagaagatggcacaggatggaggcgccccaagacggacagtgtacataagagtttcttgttgctttacaataaaacatgagaacctgca

SEQ ID NO: 9176 - DNA, 1848 bp, Homo sapiens
atttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttct

SEQ ID NO: 9177 - DNA, 4994 bp, Homo sapiens
gtgctgccgtgtgggcaagctctgtggggagaggggaggccagtgggttgtttttgccatcacagaatactgggaagcccctggcatcctgctccatagctctcttcaccactatcctggaaccttctccccacccccatccccatgcctccaaggcactgacctcaaatccaagtctttctcacttatctcaagctgccagcctgtagggattccttatctcagctccatgtcagcggtgaggaagccccaagaaggcaagggagctgacagccttctcatttttctcgtacatcctcctgttcaccccgccatcccgggagccccagccagatgctcttcagggcagggagcacgtgagcagccctggggctagaagccggttctcccacattcctgggtgagggactgggtggagggtgtgcctgcctcaggctccttgggggaggccccctgaagggctggggaaaatcctactgagccccaggctctcctgcctgcactggcccagtgcgggggcgggggggcggggggatcctggacattaactctctcctaggcacctgggagcttcagagaggaagaaggtaaggtaagaagcagattctctgcgcaggactttcttagtcctcaggctatagagttaaagaaagaagtatctgtagaaggtggagtcaccttttgtttgagtaaccgtttcacccaccctggctgagggtggccaggaactccccaagttgtgcattaatggaggggggtcacacagatcctacatttttttgtttttgtttttttttttttgagacgcagtgattacaggtgtgagccaccggatcctacatttcaaatgcataaaaatctagatatgggctgggcgcagtagctcatgcctgtaatcccagcactttgggaggctgaggcaggcagatcatgaggtcaggagatcgagtccatcctggctaacatggtgaaaccccgtctctactaaaaatacagaaagccgggcatggcagcgggcgcctgtaatcccagctactcggaaagctgaggcaggagaatcgcttgaacccaggagtcagaggttgcagtgagcagagatcacgccactgcactccaacctgggcgacagagcgagactccacctcaaaacaaaataaacaaaatactagatctggaagagatcttagggattattaaattcagacaacctcattttttatagatggggaaacaagcacagactccaagggtctcatccaagatcacacagttgcagatgctggctacaagtctcctgcctcaaccacctgtattaccccattcagggtctcaagaagggtctataagacactatccattgtgtttcgggctgagtccatagagacaaccacagacatgggggactctgcccacagggaaggcaagggctctggccatggagctggatgggaagactctgaagcccgaagacattgaatcctgtgcagggaaagagcgagggttttgtgtacaacacacctgcatacctggatgtgaatctcagctccaccccttcaccaactctgtgtggcctgggcaagccattctaagggaaccctccacactgcaactttcatgtctataaaatgggaataaccatgcattccttacaggacttttttggtgtgaggattaaatgagagaatatgttgaaaagtgcttggtaaatatattaatactatgcattccctcttctttgaatgacgtgacccaggtagtcaggcttctgaccactagagggcagcagaaggtactggaaaactgggccgagtgaaccagagattagatggggtccagagagcagggatgaacttacccgtgtggattctggcaactccggcagggagggctccagcaggcgctgagggaagaactttcaagcagagccgggtctcttcaggagcgactgcagcaaccctgatgcttggatggagtccaggcaggtgatggtagtgaagaccttgccaacagagtgggcgctggagaaggagccctttagtggggaccctggggccacgactaggctggcaggcccagccagcaccaattaatccatgagtattgcccagcattgagcctggagcaccttccagcccctggccagagtcctgggtgttctgggaaaaacccctaaacctagtaactcctctccctactaggcctctttgttgctgaatctctggaatttaggggccagcagctttctgactcaggtcagccaggggttcatgttccctcacttgccctccccctgcctggcccatctctggcctggcccctgggaggaatttcctgggccagagggcagccgaaagcacagatgcccaccccagcaacgttcccgccacctgcccaggccagtgccccgtgcccaaccccagagggtgcgggatgacagactctgacaatcattaaaccagccgggcctgatttcccagcactgcctgctaagatccgggccaagtggcactgaatatgcaaatcacctggggccaggagcccagtctaaaggccaggaaatcccctccatccaatgagacaccagctcaggttactgcaggggacacactataaagccctgagctcagggaggagctccctccaggctctatttagagccgggtaggggagcgcagcggccagatacctcagcgctacctggcggaactggatttctctcccgcctgccggcctgcctgccacagccggactccgccactccggtaggattccccgcctgtcattccctagcccagctcttgggaaactgcagaggggtccagaggatttgcagttctgaacctgcacactccagtctaggatctccgagcaagagcgtaggtgtcctgagggtcaaagaacagagagagattgtctctgggaaggcagaatggccatgacgccgctagtctggctccagggccccagagatctgaggagggaagcccagctggaggctcctgtggtcctgccctggtctgagatcttggagcccttcttgaagagacggtgtccgcagagttgctgatcttcctgcccctgggggctactcttgcccagggttgggcaaagcagagtagctgggagtgtaaggagaggaccctcgtcccctcaccaacctcatcctctctccccctacccacaggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccctggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctt

SEQ ID NO: 9178 - DNA, 2044 bp, Homo sapiens
aggctctatttagagccgggtaggggagcgcagcggccagatacctcagcgctacctggcggaactggatttctctcccgcctgccggcctgcctgccacagccggactccgccactccggtaggattccccgcctgtcattccctagcccagctcttgggaaactgcagaggggtccagaggatttgcagttctgaacctgcacactccagtctaggatctccgagcaagagcgtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccctggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctt

SEQ ID NO: 9179 - DNA, 3179 bp, Homo sapiens
atgagacaccagctcaggttactgcaggggacacactataaagccctgagctcagggaggagctccctccaggctctatttagagccgggtaggggagcgcagcggccagatacctcagcgctacctggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggagggtacagagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccctggcagctctgacgtctccaccgcagggactggtgcttctcggagctcccactcctcagactccggtggaagtgacgtggacctggatcccactgatggcaagctcttccccagcgatggttttcgtgactgcaagaagggggatcccaagcacgggaagcggaaacgaggccggccccgaaagctgagcaaagagtactgggactgtctcgagggcaagaagagcaagcacgcgcccagaggcacccacctgtgggagttcatccgggacatcctcatccacccggagctcaacgagggcctcatgaagtgggagaatcggcatgaaggcgtcttcaagttcctgcgctccgaggctgtggcccaactatggggccaaaagaaaaagaacagcaacatgacctacgagaagctgagccgggccatgaggtactactacaaacgggagatcctggaacgggtggatggccggcgactcgtctacaagtttggcaaaaactcaagcggctggaaggaggaagaggttctccagagtcggaactgagggttggaactatacccgggaccaaactcacggaccactcgaggcctgcaaaccttcctgggaggacaggcaggccagatggcccctccactggggaatgctcccagctgtgctgtggagagaagctgatgttttggtgtattgtcagccatcgtcctgggactcggagactatggcctcgcctccccaccctcctcttggaattacaagccctggggtttgaagctgactttatagctgcaagtgtatctccttttatctggtgcctcctcaaacccagtctcagacactaaatgcagacaacaccttcctcctgcagacacctggactgagccaaggaggcctggggaggccctaggggagcaccgtgatggagaggacagagcaggggctccagcaccttctttctggactggcgttcacctccctgctcagtgcttgggctccacgggcaggggtcagagcactccctaatttatgtgctatataaatatgtcagatgtacatagagatctattttttctaaaacattcccctccccactcctctcccacagagtgctggactgttccaggccctccagtgggctgatgctgggacccttaggatggggctcccagctcctttctcctgtgaatggaggcagagacctccaataaagtgccttctgggctttttctaacctttgtcttagctacctgtgtactgaaatttgggcctttggatcgaatatggtcaagaggttggaggggaggaaaatgaaggtctaccaggctgagggtgagggcaaaggctgacgaagaggggagttacagatttcctgtagcaggtgtgggcttacagacacatggactgggctgggaggcgagcaaaggaagcagctgagactgttggagaacgcttacaagacttcatgcaagcaaggacatgaactcagaacactgaggtcagaagcatcctgctgtcatgacaccgctcgagtgaccttgaccttgaccaagtctgtcctgtttaggactgatttttcctattaggctagggtttggacctgatgttctcaagatgtctagaattgcatggctggccttgtggaatagatggttttgcattccagccaagtgtgctgtaaactgtatatctgtaatatgaatcccagcttttgagtctgacaaaatcagagttaggatcttgtaaaggaaaaaaaaaaaaaaacaaaacaaaatggagatgagtacttgctgagaaagaatgagggaaggagttggcatttgttgaaagtgtagtctttttctcttttttttttaattgcaacttttactttagatttaggaggtcgtgcgcaggtttgttacatgggtatattgtgtgatgctgagcttgggatgcgaatgatcctgtcacccaggtagtgagtatagcacccagtgaaactgtagtctcatgccaggcactgtgctagcccactctggctcatttaatcctctcctaagaagagaggagacacagcgtccccatttgacagatgcagaaagaggttccacaggtgtgccttgattctgtcctaaaaccgtttcccggaagcttttcctggtgtgggcgcttctaacctaatcctcaatcgattccagaactattactctgtttccacagtgatactgtgtctaggttttagggaggacagttcattgatgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaactaaa

SEQ ID NO: 9180 - DNA, 769 bp, Homo sapiens
ggcggaactggatttctctcccgcctgccggcctgcctgccacagccggactccgccactccggtagcctcatggctgcaacctgtgagattagcaacatttttagcaactacttcagtgcgatgtacagctcggaggactccaccctggcctctgttccccctgctgccacctttggggccgatgacttggtactgaccctgagcaacccccagatgtcattggaggagaaggccagctggttgggggaacagccccagttctggtcgaagacgcaggttctggactggatcagctaccaagtggagaagaacaagtacgacgcaagcgccattgacttctcacgatgtgacatggatggcgccaccctctgcaattgtgcccttgaggagctgcgtctggtctttgggcctctgggggaccaactccatgcccagctgcgagacctcacttccagctcttctgatgagctcagttggatcattgagctgctggagaaggatggcatggccttccaggaggccctagacccagggccctttgaccagggcagcccctttgcccaggagctgctggacgacggtcagcaagccagcccctaccaccccggcagctgtggcgcaggagccccctcccctggcagctctgacgtctccaccgcagggactggtgcttctcggagctcccactcctcagactccggtggaagtgacgtggacctggatcccactgatggcaagctcttccccagcgatggttttcgtgactg

SEQ ID NO: 9181 - DNA, 4165 bp, Homo sapiens
ttctcctttcgccggcgccgagttcctggcgccgctcgcccggcccggcttccgaggggagaggacgggctggcggggctggggacccgcgtctcggcccccggagcggggaccacggagacagaccccggcccggcgaccgagctgggcccgtgagccactcggcctcaggtcgctcctgtggttggtccagcccagaatgcagccttgagcctggcttaggccaccacctactccagctctctccaccccctattttactgcagctcagggggtaggctctaggctccaaagtacctgggtattgtcccttcatcaagaaagccccacagctctggagggctctgataatcccgttgtcagctctctgaaaagacagcatggctattaccctacagcccagtgacctgatctttgagttcgcaagcaacgggatggatgatgatatccaccagctggaagacccctctgtgttcccagctgtgatcgtggagcaggtaccctaccctgatttactgcatctgtactcgggactggagttggacgacgttcacaatggcatcataacagacgggaccttgtgcatgacgcaggatcagatcctggaaggcagttttttgctgacagatgacaatgaggccacctcgcacaccatgtcaaccgcggaagtcttactcaatatggagtctcccagcgatatcctggatgagaagcagatcttcagtacctccgaaatgcttccagactcggaccctgcaccagctgtcactctgcccaactacctgtttcctgcctctgagcccgatgccctgaacagggcgggtgacactagtgaccaggaggggcattctctggaggagaaggcctccagagaggaaagtgccaagaagactgggaaatcaaagaagagaatccggaagaccaagggcaaccgaagtacctcacctgtcactgaccccagcatccccattaggaagaaatcaaaggatggcaaaggcagcaccatctatctgtgggagttcctcctggctcttctgcaagacagaaacacctgtcccaagtacatcaagtggacccagcgagagaaaggcatcttcaaactggtggactccaaagctgtgtccaagctgtgggggaagcagaaaaacaagcctgacatgaactatgagacaatggggcgggcactaagatactactaccaaagaggcatactggccaaagtggaagggcagaggctggtgtaccagtttaaggagatgcccaaggacctggtggtcattgaagatgaggatgagagcagcgaagccacagcagccccacctcaggcctccacggcctctgtggcctctgccagtaccacccggcgaaccagctccagggtctcatccagatctgccccccagggcaagggcagctcttcttgggagaagccaaaaattcagcatgtcggtctccagccatctgcgagtctggaattgggaccgtcgctagacgaggagatccccactacctccaccatgctcgtctctccagcagagggccaggtcaagctcaccaaagctgtgagtgcatcttcagtgcccagcaacatccacctaggagtggcccccgtggggtcgggctcggccctgaccctgcagacgatcccactgaccacggtgctgaccaatgggcctcctgccagtactactgctcccactcagctcgttctccagagtgttccagcggcctctactttcaaggacaccttcactttgcaggcctctttccccctgaacgccagtttccaagacagccaggtggcagccccaggggctccactgattctcagtggcctcccccaacttctggctggggccaaccgtccgaccaacccggcgccacccacggtcacaggggctggaccagcagggcccagctctcagccccctgggactgtcattgctgccttcatcaggacttctggcactacagcagcccctagggtcaaggaggggccactgaggtcctcctcctatgttcagggtatggtgacgggggcccccatggaggggctgctggttcctgaagagaccctgagggagctcctgagagatcaggctcatcttcagccacttccaacccaggtggtttccaggggttcccacaatccgagccttctgggcaaccagactttgtctcctcccagccgccccactgttgggctgaccccagtggctgaacttgagctctcctcaggctcagggtccctgctgatggctgagcctagtgtgaccacatctgggagccttctgacaagatcccccaccccagcccctttctccccattcaaccctacttccctcattaagatggagccccatgacatataagcaaaggggtcagggcaagtgtgacccaccaggcaaaattgagcagcattttcatagggaccgacttcagtagcacacctgcccctgcatttcagtgggatgtcaatacacttgaccccaagtcccccggccctgcctggtgtcactgtggccaaacagtgcccagcttaagcatccctggcatcagactatggccttcaagagcactagggcatatgcttttggcagcataacgggctgacttggtgatggagggaaaaagccttgagccaggcagaagtttgtggccagggtttgtgcagcagctttgtgagaagagcccttctacctggctctatctcactggctgcattccctacacagggaatttactaccctatatgtgaatatccctgtatgtacttgtgtgtacttgttggtctgtatcttagtttctttggggaggacagggctgtagctgtgaggtcttgtctccaagggtgtgtgtatgtctccgtggatcagccacagggatagggattttgtttttaagggaaagcattctctaattccctttgttcatgccgagattcagttgctctgagactatggggtacaagtttgatcctccgaatctggagatgttgtagagctggaacgagtgcagagtaggaacgctttgatgcgcatgcacattggggaagatgcgctcctcagggacacaaaggccgagtggggtaaaaccacgaagggagggaagggaagtcagctctgggagcagccctcactggctggaccaaggtactcttcctggagtttgccgtgttagcaaccacagtcaccttgcagtcaggctggaatcttgggccaccccaaagtgctttgctgaaggatttagacggggatgaagtgccctccagcctcagagctagccacaaagcccccagagctgaattcattgagtatttgtgcctagggcttgggctgtttgtgtgataccggccccccgccagacaatagcctttgctgacaccccagcctacttccccgatcctgggctccctcttgattactttttgacattttccagctgtcaggcatcactgcggctagtccggcagcgacctagatggggtccacccccattcctgctcaagcatgggcacctaccacatggtttctgctgctcagcctgcctgcaactcacctcgaaggcggaccagcctgcctctgtgatgactgcagcagacctccttgggtgtaccaatgcccctcatctcccactttcacacctaaccctgactccttcaccaagaagacgggagtcggcagccaggagttcccgtggcacctctctctcttcgtggctccctgcttcccccttccctctttccgaggaagggtcaacctattctctctcaaagccaacccctaggccaattgcctggatctcctcccctctcccttctttaaacgagcttgcctccctcctgccaagtttgagggcaaggctaagaaatgtcagccacggaaacaactctattatctggtgactttgggtaatgtgaatcagtgcctgaggacctttgctgtgtccttggtacagaaccatccacttgacctaactacctcccctggccgcgctctcgctcttctcttctttgttaagccaacaactatcaccctctcctactcttcttctccctgccccctggagggcactgtgtttggttgtgcaaatgtatttactatgcgtgtttccagcagttggcattaaagtgcctttttctaataaaatcagtttattatgacag

SEQ ID NO: 9182 - DNA, 4145 bp, Homo sapiens
ggtatttgcatctctccctccaacttgccattggcggcgcgaagtgtgggagagccctgcgcctcgcccgcccggaccagcctgccccggcgccgaggtcgctcctgtggttggtccagcccagaatgcagccttgagcctggcttaggccaccacctactccagctctctccaccccctattttactgcagctcagggggtaggctctaggctccaaagtacctgggtattgtcccttcatcaagaaagccccacagctctggagggctctgataatcccgttgtcagctctctgaaaagacagcatggctattaccctacagcccagtgacctgatctttgagttcgcaagcaacgggatggatgatgatatccaccagctggaagacccctctgtgttcccagctgtgatcgtggagcaggtaccctaccctgatttactgcatctgtactcgggactggagttggacgacgttcacaatggcatcataacagacgggaccttgtgcatgacgcaggatcagatcctggaaggcagttttttgctgacagatgacaatgaggccacctcgcacaccatgtcaaccgcggaagtcttactcaatatggagtctcccagcgatatcctggatgagaagcagatcttcagtacctccgaaatgcttccagactcggaccctgcaccagctgtcactctgcccaactacctgtttcctgcctctgagcccgatgccctgaacagggcgggtgacactagtgaccaggaggggcattctctggaggagaaggcctccagagaggaaagtgccaagaagactgggaaatcaaagaagagaatccggaagaccaagggcaaccgaagtacctcacctgtcactgaccccagcatccccattaggaagaaatcaaaggatggcaaaggcagcaccatctatctgtgggagttcctcctggctcttctgcaagacagaaacacctgtcccaagtacatcaagtggacccagcgagagaaaggcatcttcaaactggtggactccaaagctgtgtccaagctgtgggggaagcagaaaaacaagcctgacatgaactatgagacaatggggcgggcactaagatactactaccaaagaggcatactggccaaagtggaagggcagaggctggtgtaccagtttaaggagatgcccaaggacctggtggtcattgaagatgaggatgagagcagcgaagccacagcagccccacctcaggcctccacggcctctgtggcctctgccagtaccacccggcgaaccagctccagggtctcatccagatctgccccccagggcaagggcagctcttcttgggagaagccaaaaattcagcatgtcggtctccagccatctgcgagtctggaattgggaccgtcgctagacgaggagatccccactacctccaccatgctcgtctctccagcagagggccaggtcaagctcaccaaagctgtgagtgcatcttcagtgcccagcaacatccacctaggagtggcccccgtggggtcgggctcggccctgaccctgcagacgatcccactgaccacggtgctgaccaatgggcctcctgccagtactactgctcccactcagctcgttctccagagtgttccagcggcctctactttcaaggacaccttcactttgcaggcctctttccccctgaacgccagtttccaagacagccaggtggcagccccaggggctccactgattctcagtggcctcccccaacttctggctggggccaaccgtccgaccaacccggcgccacccacggtcacaggggctggaccagcagggcccagctctcagccccctgggactgtcattgctgccttcatcaggacttctggcactacagcagcccctagggtcaaggaggggccactgaggtcctcctcctatgttcagggtatggtgacgggggcccccatggaggggctgctggttcctgaagagaccctgagggagctcctgagagatcaggctcatcttcagccacttccaacccaggtggtttccaggggttcccacaatccgagccttctgggcaaccagactttgtctcctcccagccgccccactgttgggctgaccccagtggctgaacttgagctctcctcaggctcagggtccctgctgatggctgagcctagtgtgaccacatctgggagccttctgacaagatcccccaccccagcccctttctccccattcaaccctacttccctcattaagatggagccccatgacatataagcaaaggggtcagggcaagtgtgacccaccaggcaaaattgagcagcattttcatagggaccgacttcagtagcacacctgcccctgcatttcagtgggatgtcaatacacttgaccccaagtcccccggccctgcctggtgtcactgtggccaaacagtgcccagcttaagcatccctggcatcagactatggccttcaagagcactagggcatatgcttttggcagcataacgggctgacttggtgatggagggaaaaagccttgagccaggcagaagtttgtggccagggtttgtgcagcagctttgtgagaagagcccttctacctggctctatctcactggctgcattccctacacagggaatttactaccctatatgtgaatatccctgtatgtacttgtgtgtacttgttggtctgtatcttagtttctttggggaggacagggctgtagctgtgaggtcttgtctccaagggtgtgtgtatgtctccgtggatcagccacagggatagggattttgtttttaagggaaagcattctctaattccctttgttcatgccgagattcagttgctctgagactatggggtacaagtttgatcctccgaatctggagatgttgtagagctggaacgagtgcagagtaggaacgctttgatgcgcatgcacattggggaagatgcgctcctcagggacacaaaggccgagtggggtaaaaccacgaagggagggaagggaagtcagctctgggagcagccctcactggctggaccaaggtactcttcctggagtttgccgtgttagcaaccacagtcaccttgcagtcaggctggaatcttgggccaccccaaagtgctttgctgaaggatttagacggggatgaagtgccctccagcctcagagctagccacaaagcccccagagctgaattcattgagtatttgtgcctagggcttgggctgtttgtgtgataccggccccccgccagacaatagcctttgctgacaccccagcctacttccccgatcctgggctccctcttgattactttttgacattttccagctgtcaggcatcactgcggctagtccggcagcgacctagatggggtccacccccattcctgctcaagcatgggcacctaccacatggtttctgctgctcagcctgcctgcaactcacctcgaaggcggaccagcctgcctctgtgatgactgcagcagacctccttgggtgtaccaatgcccctcatctcccactttcacacctaaccctgactccttcaccaagaagacgggagtcggcagccaggagttcccgtggcacctctctctcttcgtggctccctgcttcccccttccctctttccgaggaagggtcaacctattctctctcaaagccaacccctaggccaattgcctggatctcctcccctctcccttctttaaacgagcttgcctccctcctgccaagtttgagggcaaggctaagaaatgtcagccacggaaacaactctattatctggtgactttgggtaatgtgaatcagtgcctgaggacctttgctgtgtccttggtacagaaccatccacttgacctaactacctcccctggccgcgctctcgctcttctcttctttgttaagccaacaactatcaccctctcctactcttcttctccctgccccctggagggcactgtgtttggttgtgcaaatgtatttactatgcgtgtttccagcagttggcattaaagtgcctttttctaataaaatcagtttattatgacagtttcctgatggttgaaagtaagcatcttgataaagggtcaccattaaaaaaaaa

SEQ ID NO: 9183 - DNA, 406 bp, Homo sapiens
ggcgaccgagctgggcccgtgagccactcggcctcaggtcgctcctgtggttggtccagcccagaatgcagccttgagcctggcttaggccaccacctactccagctctctccaccccctattttactgcagctcaggggcccagtgacctgatctttgagttcgcaagcaacgggatggatgatgatatccaccagctggaagacccctctgtgttcccagctgtgatcgtggagcaggtaccctaccctgatttactgcatctgtactcgggactggagttggacgacgttcacaatggcatcataacagacgggaccttgtgcatgacgcaggatcagatcctggaaggcagttttttgctgacagatgacaatgaggccacctcgcacaccatgtcaaccgc

SEQ ID NO: 9184 - DNA, 2321 bp, Homo sapiens
gtaggtgtcacttatatcacaaggctacaggtgtctttatttccactgcacgctggtgctgggagcgcctgccttctcttgccttgaaagcctcctctttggacctagccaccgctgccctcacggtaatgttggactcggtgacacacagcaccttcctgcctaatgcatccttctgcgatcccctgatgtcgtggactgatctgttcagcaatgaagagtactaccctgcctttgagcatcagacagcctgtgactcatactggacatcagtccaccctgaatactggactaagcgccatgtgtgggagtggctccagttctgctgcgaccagtacaagttggacaccaattgcatctccttctgcaacttcaacatcagtggcctgcagctgtgcagcatgacacaggaggagttcgtcgaggcagctggcctctgcggcgagtacctgtacttcatcctccagaacatccgcacacaaggttactccttttttaatgacgctgaagaaagcaaggccaccatcaaagactatgctgattccaactgcttgaaaacaagtggcatcaaaagtcaagactgtcacagtcatagtagaacaagcctccaaagttctcatctatgggaatttgtacgagacctgcttctatctcctgaagaaaactgtggcattctggaatgggaagatagggaacaaggaatttttcgggtggttaaatcggaagccctggcaaagatgtggggacaaaggaagaaaaatgacagaatgacatatgaaaagttgagcagagccctgagatactactataaaacaggaattttggagcgggttgaccgaaggttagtgtacaaatttggaaaaaatgcacacgggtggcaggaagacaagctatgatctgctccaggcatcaagctcattttatggatttctgtcttttaaaacaatcagattgcaatagacattcgaaaggcttcattttcttctctttttttttaacctgcaaacatgctgataaaatttctccacatctcagcttacatttggattcagagttgttgtctatggagggtgagagcagaaactcttaagaaatcctttcttctccctaaggggatgaggggatgatcttttgtggtgtcttgatcaaactttattttcctagagttgtggaatgacaacagcccatgccattgatgctgatcagagaaaaactattcaattctgccattagagacacatccaatgctcccatcccaaaggttcaaaagttttcaaataactgtggcagctcaccaaaggtgggggaaagcatgattagtttgcaggttatggtaggagagggtgagatataagacatacatactttagattttaaattattaaagtcaaaaatccatagaaaagtatccctttttttttttttgagacgggttctcactatgttgcccagggctggtcttgaactcctatgctcaagtgatcctcccacctcagcctcccaaagtactgtgattacaagcgtgagccacggcacctgggcagaaaagtatcttaattaatgaaagagctaagccatcaagctgggacttaattggatttaacataggttcacagaaagtttcctaaccagagcatctttttgaccactcagcaaaacttccacagacatccttctggacttaaacacttaacattaaccacattattaattgttgctgagtttattcccccttctaactgatggctggcatctgatatgcagagttagtcaacagacactggcatcaattacaaaatcactgctgtttctgtgattcaagctgtcaacacaataaaatcgaaattcattgattccatctcaggtccagatgttaaacgtttataaaaccggaaatgtcctaacaactctgtaatggcaaattaaattgtgtgtcttttttgttttgtctttctacctgatgtgtattcaagcgctataacacgtatttccttgacaaaaatagtgacagtgaattcacactaataaatgttcataggttaaagtctgcactgacattttctcatcaatcactggtatgtaagttatcagtgactgacagctaggtggactgcccctaggacttctgtttcaccagagcaggaatcaagtggtgaggcactgaatcgctgtacaggctgaagacctccttattagagttgaacttcaaagtaacttgttttaaaaaatatgaattactgtaaaataatctattttggattcatgtgttttccaggtggatatagtttgtaaacaatgtgaataaagtatttaacatgttc

SEQ ID NO: 9185 - DNA, 2450 bp, Homo sapiens
ggctgagtggtttgctccttcccctctctctgggaggctgagcaggggtgccgggttgctcaggccatgggagccacacctgttattgctgcctctgatttgtgtgacactgagaagcccacaggcctgtccctccaactcggtggaccctctctgtgtgcatttggtgtgtgagccagctctgagaagggttcagaagccactggaggcatctggggacctcagcttccatgccatctctgcctcactcccacagggtaatgttggactcggtgacacacagcaccttcctgcctaatgcatccttctgcgatcccctgatgtcgtggactgatctgttcagcaatgaagagtactaccctgcctttgagcatcagacagcctgtgactcatactggacatcagtccaccctgaatactggactaagcgccatgtgtgggagtggctccagttctgctgcgaccagtacaagttggacaccaattgcatctccttctgcaacttcaacatcagtggcctgcagctgtgcagcatgacacaggaggagttcgtcgaggcagctggcctctgcggcgagtacctgtacttcatcctccagaacatccgcacacaaggttactccttttttaatgacgctgaagaaagcaaggccaccatcaaagactatgctgattccaactgcttgaaaacaagtggcatcaaaagtcaagactgtcacagtcatagtagaacaagcctccaaagttctcatctatgggaatttgtacgagacctgcttctatctcctgaagaaaactgtggcattctggaatgggaagatagggaacaaggaatttttcgggtggttaaatcggaagccctggcaaagatgtggggacaaaggaagaaaaatgacagaatgacatatgaaaagttgagcagagccctgagatactactataaaacaggaattttggagcgggttgaccgaaggttagtgtacaaatttggaaaaaatgcacacgggtggcaggaagacaagctatgatctgctccaggcatcaagctcattttatggatttctgtcttttaaaacaatcagattgcaatagacattcgaaaggcttcattttcttctctttttttttaacctgcaaacatgctgataaaatttctccacatctcagcttacatttggattcagagttgttgtctatggagggtgagagcagaaactcttaagaaatcctttcttctccctaaggggatgaggggatgatcttttgtggtgtcttgatcaaactttattttcctagagttgtggaatgacaacagcccatgccattgatgctgatcagagaaaaactattcaattctgccattagagacacatccaatgctcccatcccaaaggttcaaaagttttcaaataactgtggcagctcaccaaaggtgggggaaagcatgattagtttgcaggttatggtaggagagggtgagatataagacatacatactttagattttaaattattaaagtcaaaaatccatagaaaagtatccctttttttttttttgagacgggttctcactatgttgcccagggctggtcttgaactcctatgctcaagtgatcctcccacctcagcctcccaaagtactgtgattacaagcgtgagccacggcacctgggcagaaaagtatcttaattaatgaaagagctaagccatcaagctgggacttaattggatttaacataggttcacagaaagtttcctaaccagagcatctttttgaccactcagcaaaacttccacagacatccttctggacttaaacacttaacattaaccacattattaattgttgctgagtttattcccccttctaactgatggctggcatctgatatgcagagttagtcaacagacactggcatcaattacaaaatcactgctgtttctgtgattcaagctgtcaacacaataaaatcgaaattcattgattccatctcaggtccagatgttaaacgtttataaaaccggaaatgtcctaacaactctgtaatggcaaattaaattgtgtgtcttttttgttttgtctttctacctgatgtgtattcaagcgctataacacgtatttccttgacaaaaatagtgacagtgaattcacactaataaatgttcataggttaaagtctgcactgacattttctcatcaatcactggtatgtaagttatcagtgactgacagctaggtggactgcccctaggacttctgtttcaccagagcaggaatcaagtggtgaggcactgaatcgctgtacaggctgaagacctccttattagagttgaacttcaaagtaacttgttttaaaaaatatgaattactgtaaaataatctattttggattcatgtgttttccaggtggatatagtttgtaaacaatgtgaataaagtatttaacatg

SEQ ID NO: 9186 - DNA, 637 bp, Homo sapiens
tgtctgtaggtgtcacttatatcacaaggctacaggtgtctttatttccactgcacgctggtgctgggagcgcctgccttctcttgccttgaaagcctcctctttggacctagccaccgctgccctcacggtaatgttggactcggtgacacacagcaccttcctgcctaatgcatccttctgcgatcccctgatgtcgtggactgatctgttcagcaatgaagagtactaccctgcctttgagcatcagacagatgctgattccaactgcttgaaaacaagtggcatcaaaagtcaagactgtcacagtcatagtagaacaagcctccaaagttctcatctatgggaatttgtacgagacctgcttctatctcctgaagaaaactgtggcattctggaatgggaagatagggaacaaggaatttttcgggtggttaaatcggaagccctggcaaagatgtggggacaaaggaagaaaaatgacagaatgacatatgaaaagttgagcagagccctgagatactactataaaacaggaattttggagcgggttgaccgaaggttagtgtacaaatttggaaaaaatgcacacgggtggcaggaagacaagctatgatctgctccaggcatcaagctc

SEQ ID NO: 9187 - DNA, 5145 bp, Homo sapiens
attcatggggcccgcgcgcggctgcagccgggctccgtggcgctcgcagccaccgcctcctctcggctccaggtcttccccttctttttacaactgatcctgttggggattttttttttttctaaattggaacggtggggaggagcagggaggggggacctggaggaaggggagagattaggcagccatcaatttcctccagtttctcccagaacaggtgatgcttctaaattgtgatcactttcaggaggcagcactgcagctggaaggatgcgagcgacctagggtggagtggctgaggcggcagatctgaacttgcggaggataagaacccaaactttgactacatcagtccgcacctcgccagtgaagcaaaggacgggttatcttttttttttttctaagactcaaacttgggcacttgatcccttttcttggattgctttggaggagacgatttgctggcaacgttgggaacagtcaggactgtgttgtaactcttacttttaaagcgacagtagaggatcagactttttaaatgtttggaattcaagatactttaggaagaggaccaactctgaaagagaaatcgctgggcgcggagatggattcggtcaggtcctgggtccggaatgtcggagtggtggacgctaatgtcgccgcgcagagcggggtcgccctgtcccgggcccactttgagaaacagcctccttccaacttgaggaaatccaacttctttcacttcgtcctggcgctctatgacaggcagggccagccggtggagatcgagcggacggccttcgtggactttgtggagaatgacaaagaacaaggcaacgagaagaccaacaacggcactcactacaagttacagctcctctacagcaacggtgtccgcacggaacaggacctctatgtcaggctcatcgactcggtcaccaagcagcccatcgcttacgagggacagaataagaatccggaaatgtgccgagttctcctgacgcacgaagtgatgtgtagtcgatgctgcgaaaagaaaagctgtggaaaccgaaatgagactccatcggacccagtcataattgacagattctttttaaaatttttcctcaagtgcaatcagaattgtttgaaaacagcaggaaacccaagggacatgagacggtttcaggttgtgttgtcaacaacggtgaatgtggatggacacgtcctggctgtttctgacaacatgtttgttcataacaactccaagcatggacggagagcaagaagactcgatccatcggaagctaccccctgcatcaaagccattagcccgagtgaaggctggaccacaggaggagccatggtcatcatcatcggggacaacttctttgatggtctccaagtggtgtttgggactatgcttgtatggagcgagctaataacccctcatgccatcagagtacagactcctccccggcacatcccaggcgtggtagaggtgacattatcttataaatctaaacagttctgcaaaggagccccaggaaggttcatttacacagcattaaatgaacccaccatagactatggcttccagagactgcagaaggtcatccctaggcatcctggagatcctgagagattagctaaggagatgctgttgaaaagagctgcagatctagtggaagctctttatggcacaccacacaataaccaggacatcattttgaagcgagccgcagacattgctgaagctctctacagcgtccccaggaatcccagccagcttccagccctctctagctccccagcgcacagtggcatgatgggaatcaactcctatggcagccagcttggggtcagcatctcagagtcaacacaaggaaataatcaagggtacatccgcaacacaagcagcatctctccgcggggatactcttccagctccacgcctcaacagtctaattacagtacctccagcaacagtatgaatggctacagcaatgtccccatggccaacttgggtgttccaggttcaccaggatttctaaatggctcacccaccggctctccttatggaatcatgtcatcaagtcccaccgttgggtcttccagcacatcctccatcctcccattttcctcttcagtttttcctgctgtcaaacagaagagtgcctttgcccctgtcatcaggccccaaggctccccttcacctgcctgctccagcggcaatggaaatggattcagagccatgaccggacttgttgtacccccgatgtaaagaagaactgctttcttatagcacaaaactacttactctgatggaccaataatgaagaaagcactaggagctcttttgggggtgtagtggtgcccccacatgaacatgatggacacccttgggtctgcaaggagccagcatcttacttggtcccacgtcctcctatagctctgatggtggctacacaaactgaccctcttgggacaaggacaaaagatgtcattgacgtagtcagtgctaagagcagaaatgcaattctttgttatgaacattatgaaaaccaccttcctatgtttgtaaaatatttaagaaaaaattggcaaacaattaatgcttaatattttggatactatttgtttttctttgtaggaaaaaaaagttgaaagtttctattttctatgaagcctttcagataccaatttagtttatgcagaaaaaaattgaacaaaacagggtaccagcacggaagactttcttaaaacgcaacctgaattgaatgatgaaatgttgtatgtgtgtttgcttatagcttaatctctttaaaaaatgaacaaaaaaagggaaaaattttaaaatgttttacaattatttaaataaataaatgtgtaacttattgtaagtagaggtagaaattaagacctttttttggaagagagagggatttctcttcctgatgtaaaatgaaaatgatgcaaacatgtagtaacaagttttaaaggtgtgtgattattactgcagttacttactagattcttatcccctgtcctgcaccccctccttttccatcactttattgacccaagggcaagaacatgtagattcccacagaacaccctaatgcagaaacagacactctagcacatgcacaaatactccaacccatcaattcattcccagctccgtctgatttctaaatagtccacactcttgtgaatactttttaaaattcctattattagctttcaacgttctcccctgagcagtccagagaattcccatgtttgagtctgtctcaggctttcagcatcccaaggaaagaagcacctcaccttctagcagagccaaaaccacagactttcttaaccaagggaccccttgggaattcctcctcaccagaaccccaccactccctccgctttgggtgcctggttcagtacagaggtacacagccccatagaacttcagcaacacggtttggagaagataactctgtttgatggactctttagagtcagtcttagaacatccaagtcctttcctctccctgtcaatttccccttttatggcattaaactctcttgaaaaacatagctatgccactcgacagtttctagtcaagaatgagacggaatgtgggagagggatattaaaagccctaatcccctcttctgatgttcgaagaaaggcaagaccagattcttgggagatccagagattaggggcatctgcgttctatgcagcacagttacccagccctttgatgggctcttcatcgttttgtgactagctcttagaggggaagaaccttgccttagctgctaacagtggttgattcttgaaagcttatgtaatcctagagacatatccaggcatattgggattgccaataaagatgtcacttgtttccacgttggggttctccttattgactcatgagcaccacaatagagtctatacacagacttagtttggggttcttggttgggatttcagcattagaaatagatgcagcactcatggaaaaacatcatgagtgcatctgagccaattttagatgatttcattaattctgcataccttctctttgacccattgatgcaggcccacatctatccagccccaactgtcttatttgcctttaacccattctggaattacccagtatgacttatattatttctatgcacatgagaatccaaggttttagaaacctggcatgcttataactactgctgacagtccctcatagtcagggcttaaagcgccaaaatacacggaaacataagagaaaaagtcccccagtgagaaacctgattgatggaaggggaagaatgtgtggaatatgaatgttaccttccaaaagtgaaggcagagcaaaattaagcatgtttagccctggatttgagccaatccaacataaggaaattttgttttttttaagtagcattgcttttagaacctgtgaattttccttttgcatgaagatgagtgcagtactgtcttcaaaatgattgtagaatttcttggtagctttacaccgaaaaatgcgtgtaactaaataccagacatcttgaccattcagctagaaccctggcagcaacagagctatttaattgtacaaatgtgtgtaaggattatttttagtgtactaataaattaaaaacaaagctaccctgtcctcgttagtcattgctattcaatcattccagtcccaagttatttttgtgccacttggaatatgagtatttctattggtaactacaaactctatcctgtgtttgtaagaggagctgtgtaagatttttttcatttaaagggacaatttacttcattatttatctttcttttgttatagcgttgtaattcttctcagtttttctttgcacatttcaatatgcatggtttaaaaaccattaacttctctaccttttgtacagtaaggtttcattttcacactgtatagtttcattttattgttttgctttgtcagttatatacagtataaagttgctatgcacagagctttttgtaaagacagcttttttgtttactgtttttaatggtcttacttaaagaatatcttgtttgtaaaatgaatatgtctacttcagttttaaactttaaattatcctaacaaaaaaataaaatttttgtactgt

SEQ ID NO: 9188 - DNA, 1017 bp, Homo sapiens
atggtcatcatcatcggggacaacttctttgatggtctccaagtggtgtttgggactatgcttgtatggagcgagctaataacccctcatgccatcagagtacagactcctccccggcacatcccaggcgtggtagaggtgacattatcttataaatctaaacagttctgcaaaggagccccaggaaggttcatttacacagcattaaatgaacccaccatagactatggcttccagagactgcagaaggtcatccctaggcatcctggagatcctgagagattagctaaggagatgctgttgaaaagagctgcagatctagtggaagctctttatggcacaccacacaataaccaggacatcattttgaagcgagccgcagacattgctgaagctctctacagcgtccccaggaatcccagccagcttccagccctctctagctccccagcgcacagtggcatgatgggaatcaactcctatggcagccagcttggggtcagcatctcagagtcaacacaaggaaataatcaagggtacatccgcaacacaagcagcatctctccgcggggatactcttccagctccacgcctcaacagtctaattacagtacctccagcaacagtatgaatggctacagcaatgtccccatggccaacttgggtgttccaggttcaccaggatttctaaatggctcacccaccggctctccttatggaactggactttggctcacgtggttactcaaggccttttggggaaagaaaaggattgaaacaattccgtttttatagagaaagagcatgtgtggcctgttcatgtcatcaagtcccaccgttgggtcttccagcacatcctccatcctcccattttcctcttcagtttttcctgctgtcaaacagaagagtgcctttgcccctgtcatcaggccccaaggctccccttcacctgcctgctccagcggcaatggaaatggattcagagccatgaccggacttgttgtacccccgatgtaa

SEQ ID NO: 9189 - DNA, 4510 bp, Homo sapiens
ccgccaagccccgagcgccgctgctcgaggaaacgctttcggccgggagctgcggccgccgccagcagttttcatgtttgggattcaggagaatattccgcgcggggggacgaccatgaaggaggagccgctgggcagcggcatgaacccggtgcgctcgtggatgcacacggcgggcgtggtggacgccaacacggccgcccagagcggcgtggggctggcgcgggcgcacttcgagaagcagccgccttccaacctccggaaatccaatttcttccacttcgtgctggcgctctacgataggcaggggcagccggtggagattgaaaggaccgcttttgtggactttgtggagaaagagaaagagccaaacaacgagaaaaccaacaacggcatccactataaactccagttattgtacagcaacggagtcagaacagagcaagatctgtatgttcgcctcatagattcaatgaccaaacaggccatcgtctacgagggccaggacaagaacccggagatgtgccgtgtgctgctgacccacgagatcatgtgcagccggtgctgtgacaagaaaagttgtggcaatagaaacgaaacgccctcagaccctgtaatcattgacagattctttctaaagtttttcctcaagtgcaatcagaactgtttgaagaatgcaggcaaccctcgagatatgcggagattccaggttgttgtatcgacaacagtcaacgtggacggccacgtgctggccgtgtcagacaacatgtttgtgcacaacaattccaaacacgggaggcgggcccgccgcctagacccgtcagaaggtacggccccttcttatctggaaaatgccactccgtgcatcaaggccatcagtcccagtgaaggctggaccacggggggtgccaccgtcatcataattggcgacaacttctttgacgggctgcaagttgtattcggaactatgttggtgtggagcgagctgataactccccatgccatccgagtccagaccccgccgaggcacattcctggcgtcgtcgaagtgaccctctcctacaaatccaagcagttctgcaaaggtgctcctgggcgctttgtctacaccgcccttaatgaaccaaccatagattacggctttcagaggttgcagaaagtgatcccaagacatccgggtgatcccgaaaggttacccaaggaggtgttactgaagcgggcggcggacctggtggaagccttatacggaatgcctcacaacaaccaggagatcatcttgaagcgagcggcggacatcgccgaggcgctgtacagcgttccccgcaatcacaaccagatccccaccctgggcaacaaccctgcacacacgggcatgatgggcgtcaactccttcagcagccagctagccgtcaacgtgtcagagacgtcacaagccaacgaccaagtcggctacagtcgcaatacaagcagcgtgtccccgcgaggctacgtccccagcagtactccccagcagtccaattacaacacagtcagcactagcatgaatggatatggaagtggcgccatggccagtctaggggtccctggctcgcctggatttcttaatggctcctccgctaactctccctacggcatagtgccgtccagccccaccatggcagcctcttcggtcaccctcccttcaaactgtagcagcacacacggcattttctcattctcacctgccaatgtcatctccgcagtgaaacagaagagcgccttcgcgcccgtggtccggccccaagcctctcctcctccttcctgcaccagcgccaacgggaatggactgcaagctatgtctgggctggtagtcccgccaatgtgagggacttctgtttaccttccgcagcacccagcatcaaaggacggacttcaggggacacgtttagtatattaagacatgctgatggaaacagtatcttcaaaaaaatcagcagcaattgaaatgctacaaaagactttgtttaaagattttatttaaactattaagaatcaacatgcaaacagcctacttcttcatgaacaattccattttattgactgaacttttctcatattttcacatttctcagtcctgaagaataaggaaaacaaagcgacgcctattttgtataaagtttccgactccgtcttggccatgtctagtaattgctatgtgttgggagaaactttgtgaatgcaccattttgatgatcatgaaacgctgatgaaaaatgcctccaaacatttttctgtactcatacttagattcacaatggttgtgtatctctataatgtgaaatatttttttgtggtgataaaaagagggccaaggaggtatgagccatcagactggaaaaaaggatgactatatgatgaggagaaactggggtggcagggagggagggagggtttatcactgcttaacttcatcttcatgaaatgaaactttgtaacttattgtagttagaaattgtaactttgatattgaattctcttgccttcaacaagcacactgacagagaaaaaatgctactgtctgttggttccaatattctcccactgctagagcttcctgttaagcaagtgtgatctgcaacattttttcaacttttgctagcactgtatactattgcattcttaggctactgtgaggtctatgtttcttgtaccagaaattgtccttttgacttctagatccttcttccctaatgtgttttgtatgtggttataaaattgtagacttttgtgattttgccaaagttgtagctaaatatttatacacttgtcttgaatttttttcagatccacttaaaatatttagaaaaacaagttttattccttatgtgtcttataaggaataaaatggtcttcatttgacacttactttcccatgaacacttgcagttgctaagggactttattttgtaacatatcaattataaatattgtatttatctttgaaattttgtacattgcttttcccaccttttcctttttcttctttcttgtctgtattggtttttgatcacggcctggtgttgtgatactgggaagagcattagccaagaacttgtctctttgatctgtttcgttaagctgaaccagtgtctttacatttcatttgtacttcaaaaaatatgctattgtttagactttccatcctttttttttttattttgaggaaaagtcaaattcattgtttatttttatattatttttaagttatctgaacaaatacttttgaaaaaaaagtttgttgtatagtcaaaacaaatcggtgccacccggccgtgacaaatcctagtagattctgtgcatgtggagcggccgcgaagaggtgacaccgtttggggctgtgtccttattttattttatttttttgtagaatgtaaaaagtcattttagatgccacccattgactttgccacatagctgaactgtgtttactggaaaaattcagaggcctaaagtttaaaataaaatttacttctgatgttttaattaaaatgtttgccacattaacttttctgatgccttaaaagtgaacttctttaaagaacctttgtgctattttatcacaggcttacactacaattgttaataaatacttcatttggagatgtatggtgtaaaacacacaaacacacacaaaaaagcacaagcccgctgcatgacccgtctctcctttctgggactatttctgctgcgtcctgcaccctcctgggcccacctccgattcacagaggtttcagggggacccaaatcactgctggttttcaatttttttttaacaatacatttttgtggtcagttccaacagcactgtccgtacttttaaaactggaatgacctccttcagatatcgtgcctcttagtgccaaacccacagtgagaccaaaagtgtcaggtgtttttttttttttctttctcctttgcactaagtgctttgcagacacggcacagcaaacattttgcaaactgcagcagaaatcgaatttaaaacaaaaaggagggactttaaaataccttcttgacaaaaatcaacaatgcacaacttacaaagtgttcattctagggacaaaattaaataaacagaatgtccccaggagtcagcaggtcacagtctggctttgtgatggttgacaaggtctagctacatgggaaagcctgagaagtcactttggaactaaattgcctccattttattttgtacgagtaagggtttgatctacaaaagagctcacatggacgcactgagaacgcctgccagcttccccatgccctcacttggtttgtgttttaggttaagtagtcaatgcccacatcacttcactgtctcaagactgagcacttcactaaatggtagattttactgttaaagaccctacaataagattgttttatctgtacattttttcagatatttaactgtataaaaatgttcattttacacaatatttaattaaagtatttcttgtctgtgaatttc

SEQ ID NO: 9190 - DNA, 4375 bp, Homo sapiens
ccgccaagccccgagcgccgctgctcgaggaaacgctttcggccgggagctgcggccgccgccagcagttttcatgtttgggattcaggagaatattccgcgcggggggacgaccatgaaggaggagccgctgggcagcggcatgaacccggtgcgctcgtggatgcacacggcgggcgtggtggacgccaacacggccgcccagagcggcgtggggctggcgcgggcgcacttcgagaagcagccgccttccaacctccggaaatccaatttcttccacttcgtgctggcgctctacgataggcaggggcagccggtggagattgaaaggaccgcttttgtggactttgtggagaaagagaaagagccaaacaacgagaaaaccaacaacggcatccactataaactccagttattgtacagcaacggagtcagaacagagcaagatctgtatgttcgcctcatagattcaatgaccaaacaggccatcgtctacgagggccaggacaagaacccggagatgtgccgtgtgctgctgacccacgagatcatgtgcagccggtgctgtgacaagaaaagttgtggcaatagaaacgaaacgccctcagaccctgtaatcattgacagattctttctaaagtttttcctcaagtgcaatcagaactgtttgaagaatgcaggcaaccctcgagatatgcggagattccaggttgttgtatcgacaacagtcaacgtggacggccacgtgctggccgtgtcagacaacatgtttgtgcacaacaattccaaacacgggaggcgggcccgccgcctagacccgtcagaagccactccgtgcatcaaggccatcagtcccagtgaaggctggaccacggggggtgccaccgtcatcataattggcgacaacttctttgacgggctgcaagttgtattcggaactatgttggtgtggagcgagctgataactccccatgccatccgagtccagaccccgccgaggcacattcctggcgtcgtcgaagtgaccctctcctacaaatccaagcagttctgcaaaggtgctcctgggcgctttgtctacaccgcccttaatgaaccaaccatagattacggctttcagaggttgcagaaagtgatcccaagacatccgggtgatcccgaaaggttacccaaggaggtgttactgaagcgggcggcggacctggtggaagccttatacggaatgcctcacaacaaccaggagatcatcttgaagcgagcggcggacatcgccgaggcgctgtacagcgttccccgcaatcacaaccagatccccaccctgggcaacaaccctgcacacacgggcatgatgggcgtcaactccttcagcagccagctagccgtcaacgtgtcagagacgtcacaagccaacgaccaagtcggctacagtcgcaatacaagcagcgtgtccccgcgaggctacgtccccagcagtactccccagcagtccaattacaacacagtcagcactagcatgaatggatatggaagtggcgccatggccagtctaggggtccctggctcgcctggatttcttaatggctcctccgctaactctccctacggcatgaaacagaagagcgccttcgcgcccgtggtccggccccaagcctctcctcctccttcctgcaccagcgccaacgggaatggactgcaagctatgtctgggctggtagtcccgccaatgtgagggacttctgtttaccttccgcagcacccagcatcaaaggacggacttcaggggacacgtttagtatattaagacatgctgatggaaacagtatcttcaaaaaaatcagcagcaattgaaatgctacaaaagactttgtttaaagattttatttaaactattaagaatcaacatgcaaacagcctacttcttcatgaacaattccattttattgactgaacttttctcatattttcacatttctcagtcctgaagaataaggaaaacaaagcgacgcctattttgtataaagtttccgactccgtcttggccatgtctagtaattgctatgtgttgggagaaactttgtgaatgcaccattttgatgatcatgaaacgctgatgaaaaatgcctccaaacatttttctgtactcatacttagattcacaatggttgtgtatctctataatgtgaaatatttttttgtggtgataaaaagagggccaaggaggtatgagccatcagactggaaaaaaggatgactatatgatgaggagaaactggggtggcagggagggagggagggtttatcactgcttaacttcatcttcatgaaatgaaactttgtaacttattgtagttagaaattgtaactttgatattgaattctcttgccttcaacaagcacactgacagagaaaaaatgctactgtctgttggttccaatattctcccactgctagagcttcctgttaagcaagtgtgatctgcaacattttttcaacttttgctagcactgtatactattgcattcttaggctactgtgaggtctatgtttcttgtaccagaaattgtccttttgacttctagatccttcttccctaatgtgttttgtatgtggttataaaattgtagacttttgtgattttgccaaagttgtagctaaatatttatacacttgtcttgaatttttttcagatccacttaaaatatttagaaaaacaagttttattccttatgtgtcttataaggaataaaatggtcttcatttgacacttactttcccatgaacacttgcagttgctaagggactttattttgtaacatatcaattataaatattgtatttatctttgaaattttgtacattgcttttcccaccttttcctttttcttctttcttgtctgtattggtttttgatcacggcctggtgttgtgatactgggaagagcattagccaagaacttgtctctttgatctgtttcgttaagctgaaccagtgtctttacatttcatttgtacttcaaaaaatatgctattgtttagactttccatcctttttttttttattttgaggaaaagtcaaattcattgtttatttttatattatttttaagttatctgaacaaatacttttgaaaaaaaagtttgttgtatagtcaaaacaaatcggtgccacccggccgtgacaaatcctagtagattctgtgcatgtggagcggccgcgaagaggtgacaccgtttggggctgtgtccttattttattttatttttttgtagaatgtaaaaagtcattttagatgccacccattgactttgccacatagctgaactgtgtttactggaaaaattcagaggcctaaagtttaaaataaaatttacttctgatgttttaattaaaatgtttgccacattaacttttctgatgccttaaaagtgaacttctttaaagaacctttgtgctattttatcacaggcttacactacaattgttaataaatacttcatttggagatgtatggtgtaaaacacacaaacacacacaaaaaagcacaagcccgctgcatgacccgtctctcctttctgggactatttctgctgcgtcctgcaccctcctgggcccacctccgattcacagaggtttcagggggacccaaatcactgctggttttcaatttttttttaacaatacatttttgtggtcagttccaacagcactgtccgtacttttaaaactggaatgacctccttcagatatcgtgcctcttagtgccaaacccacagtgagaccaaaagtgtcaggtgtttttttttttttctttctcctttgcactaagtgctttgcagacacggcacagcaaacattttgcaaactgcagcagaaatcgaatttaaaacaaaaaggagggactttaaaataccttcttgacaaaaatcaacaatgcacaacttacaaagtgttcattctagggacaaaattaaataaacagaatgtccccaggagtcagcaggtcacagtctggctttgtgatggttgacaaggtctagctacatgggaaagcctgagaagtcactttggaactaaattgcctccattttattttgtacgagtaagggtttgatctacaaaagagctcacatggacgcactgagaacgcctgccagcttccccatgccctcacttggtttgtgttttaggttaagtagtcaatgcccacatcacttcactgtctcaagactgagcacttcactaaatggtagattttactgttaaagaccctacaataagattgttttatctgtacattttttcagatatttaactgtataaaaatgttcattttacacaatatttaattaaagtatttcttgtctgtgaatttc

SEQ ID NO: 9191 - DNA, 817 bp, Homo sapiens
cttcagcagccagctagccgtcaacgtgtcagagacgtcacaagccaacgaccaagtcggctacagtcgcaatacaagcagcgtgtccccgcgaggctacgtccccagcagtactccccagcagtccaattacaacacagtcagcactagcatgaatggatatggaagtggcgccatggccagtctaggggtccctggctcgcctggatttcttaatggctcctccgctaactctccctacggcatagtgccgtccagccccaccatggcagcctcttcggtcaccctcccttcaaactgtagcagcacacacggcattttctcattctcacctgccaatgtcatctccgcagtgaaacagaagagcgccttcgcgcccgtggtccggccccaagcctctcctcctccttcctgcaccagcgccaacgggaatggactgcaaggctctctgctgggtgctgaggacgtagccgcggagaagacaaactggcccttttgtgaagtcggtggcatatttcactttgatgaactaatgctcaaaaaaggaactggaaagctatgtctgggctggtagtcccgccaatgtgagggacttctgtttaccttccgcagcacccagcatcaaaggacggacttcaggggacacgtttagtatattaagacatgctgatggaaacagtatcttcaaaaaaatcagcagcaattgaaatgctacaaaagactttgtttaaagattttatttaaactattaagaatcaacatgcaaacagcctacttcttcatgaacaattccattttattgactgaacttttctca

SEQ ID NO: 9192 - DNA, 2648 bp, Homo sapiens
atgttccctgcgcaggacgctctgccccgcagcgggctgaacctgaaggaggagccgctgctgcccgccggcctgggctcagtgcgctcctggatgcagggcgcgggcatcctggacgccagcaccgcggcgcagagtggcgtgggtctggcacgagcacattttgagaagcagcctccctccaacctcaggaaatccaacttcttccacttcgtgctggccatgtacgaccggcaggggcagcccgtggaggtggagcgcacagccttcatcgacttcgtggaaaaggaccgagagcccggggcggaaaagactaacaatgggatccattaccgcctccggctggtgtataacaatggactgcggacagagcaagacctctacgtgcgtctcatcgactccatgtccaaacaggccatcatctatgaggggcaggacaagaaccccgaaatgtgccgagtgctgctcacccatgagatcatgtgcagccggtgctgtgaccggaagagctgtggcaaccggaatgagacgccctcagaccccgtcatcattgacaggttcttcctcaagttcttcctcaaatgcaaccagaactgcctgaagaatgcggggaatcccagagacatgcgccgcttccaggtggtggtgtccacgacggtgagcgtggacggacacgtgctggccgtgtccgacaacatgtttgtgcacaacaactccaagcatggccgcagggcgcgccgcctggacccctccgaagctgccaccccctgcatcaaggccatcagccccggggagggctggaccacgggcggcgccaccgtcattgtcatcggcgacaacttcttcgacgggttgcaggtcgtgttcggaaacgtgctcgtgtggagcgagctcatcacgccccacgccatccgggtgcagacgcccccgcggcacatccccggggtggtggaggtgaccctctcctacaagtccaagcagttttgcaagggatgccccggccgctttgtctacacagctctgaacgagcccaccattgactacggattccagaggctacagaaagtcattcccagacaccccggagaccccgagaggctgcccaaggaagtgctgctgaagcgggcggccgacttggcagaagccctgtacggagtgcccggcagtaaccaggagctgctcctgaagcgcgcggcggacgtggccgaggctctgtacagcaccccccgcgcacccgggccgctcgcacccctggccccgagccacccacaccccgccgtcgtgggcatcaacgccttcagcagcccgctggccatcgccgtcggggacgccaccccggggcccgagccgggctacgcgcgcagctgcagcagcgcgtccccccgcgggttcgcgcccagccccggctcgcagcagagcggctacggcggcggcctcggagctggcctgggcggctacggcgcgccgggcgtggccggcctcggcgtgcctgggtcccccagcttcctcaatggctccaccgccacctcgcccttcgccatcatgccctctagccccccgctggcggctgcctcctccatgtccctcccggccgctgcccccaccaccagcgtgttctccttctcgcctgtcaacatgatctccgccgtcaaacagaggagcgccttcgcccccgtgctgcgccccccaagctccccaccccaggcctgccccagagcccacggagaggggcttccagaccagtcttttgaggattctgacaagtttcactctccagcccgggggcttcagggcctggcatactcctaattacggtctgcagctgttcccatggagcccggactggaggtccctctgggattcacagccacaccccggatggtggcacagacagatgcagggccagggccatgggcggacctcaacccgtgagctgaacggggagaggccttcaccccatgctcaagcctccccgctagcagccccacaggcttctctcgcctccctgtcttggggtagtcagaagccccagcactgtgcagatgctcttggcaggacagcatcgcagggaggtgctgggattctgggcctcactgtctgggtcttggttcctctgaaagagatggatcttgtgcagaccagggttgttgagtgaggggagcgtgggatggggaccgtgggaaagaggacagctcagggagaagtgacctggaaaggtcctgtttgcatctgacccatctcaactggcccagcatcccaacttctctgcagcgaaagggtggcgccccgcagcctcgggaggcctgcccaggctcccgtggagcttccaacagctgcttggccccgcagctgcccccacttcctttgagacctgcactctcatgcttgccgcatcatgcctccctgtgggggctttgggcatggaggaggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgcccgcccggcctctcacctgcctcctt

SEQ ID NO: 9193 - DNA, 2910 bp, Homo sapiens
gcggccgcggcggggcggcgcgggaaccgggccccggggggagtcggccgggctgctgctgctgctgctccaggtgctgccgcccggggctacggcagggccgggacgccggggcacgcggggcgctggcgctggcggcggcggcgtctgctggcccggcgcggccccagcctttccccgggacgcgcggctgctgctgctcctgccgccgctgccgccactgtcgccgccgccgccgagctccgcgcccgcagcctccgcctcccggatggacgctctgccccgcagcgggctgaacctgaaggaggagccgctgctgcccgccggcctgggctcagtgcgctcctggatgcagggcgcgggcatcctggacgccagcaccgcggcgcagagtggcgtgggtctggcacgagcacattttgagaagcagcctccctccaacctcaggaaatccaacttcttccacttcgtgctggccatgtacgaccggcaggggcagcccgtggaggtggagcgcacagccttcatcgacttcgtggaaaaggaccgagagcccggggcggaaaagactaacaatgggatccattaccgcctccggctggtgtataacaatggactgcggacagagcaagacctctacgtgcgtctcatcgactccatgtccaaacaggccatcatctatgaggggcaggacaagaaccccgaaatgtgccgagtgctgctcacccatgagatcatgtgcagccggtgctgtgaccggaagagctgtggcaaccggaatgagacgccctcagaccccgtcatcattgacaggttcttcctcaagttcttcctcaaatgcaaccagaactgcctgaagaatgcggggaatcccagagacatgcgccgcttccaggtggtggtgtccacgacggtgagcgtggacggacacgtgctggccgtgtccgacaacatgtttgtgcacaacaactccaagcatggccgcagggcgcgccgcctggacccctccgaagctgccaccccctgcatcaaggccatcagccccggggagggctggaccacgggcggcgccaccgtcattgtcatcggcgacaacttcttcgacgggttgcaggtcgtgttcggaaacgtgctcgtgtggagcgagctcatcacgccccacgccatccgggtgcagacgcccccgcggcacatccccggggtggtggaggtgaccctctcctacaagtccaagcagttttgcaagggatgccccggccgctttgtctacacagctctgaacgagcccaccattgactacggattccagaggctacagaaagtcattcccagacaccccggagaccccgagaggctgcccaaggaagtgctgctgaagcgggcggccgacttggcagaagccctgtacggagtgcccggcagtaaccaggagctgctcctgaagcgcgcggcggacgtggccgaggctctgtacagcaccccccgcgcacccgggccgctcgcacccctggccccgagccacccacaccccgccgtcgtgggcatcaacgccttcagcagcccgctggccatcgccgtcggggacgccaccccggggcccgagccgggctacgcgcgcagctgcagcagcgcgtccccccgcgggttcgcgcccagccccggctcgcagcagagcggctacggcggcggcctcggagctggcctgggcggctacggcgcgccgggcgtggccggcctcggcgtgcctgggtcccccagcttcctcaatggctccaccgccacctcgcccttcgccatcatgccctctagccccccgctggcggctgcctcctccatgtccctcccggccgctgcccccaccaccagcgtgttctccttctcgcctgtcaacatgatctccgccgtcaaacagaggagcgccttcgcccccgtgctgcgccccccaagctccccaccccaggcctgccccagagcccacggagaggggcttccagaccagtcttttgaggattctgacaagtttcactctccagcccgggggcttcagggcctggcatactcctaattacggtctgcagctgttcccatggagcccggactggaggtccctctgggattcacagccacaccccggatggtggcacagacagatgcagggccagggccatgggcggacctcaacccgtgagctgaacggggagaggccttcaccccatgctcaagcctccccgctagcagccccacaggcttctctcgcctccctgtcttggggtagtcagaagccccagcactgtgcagatgctcttggcaggacagcatcgcagggaggtgctgggattctgggcctcactgtctgggtcttggttcctctgaaagagatggatcttgtgcagaccagggttgttgagtgaggggagcgtgggatggggaccgtgggaaagaggacagctcagggagaagtgacctggaaaggtcctgtttgcatctgacccatctcaactggcccagcatcccaacttctctgcagcgaaagggtggcgccccgcagcctcgggaggcctgcccaggctcccgtggagcttccaacagctgcttggccccgcagctgcccccacttcctttgagacctgcactctcatgcttgccgcatcatgcctccctgtgggggctttgggcatggaggaggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgcccgcccggcctctcacctgcctccttggtgtg

SEQ ID NO: 9194 - DNA, 1400 bp, Homo sapiens
cgaggctctgtacagcaccccccggtcgtgggcatcaacgccttcagcagcccgctggccatcgccgtcggggacgccaccccggggcccgagccgggctacgcgcgcagctgcagcagcgcgtccccccgcgggttcgcgcccagccccggctcgcagcagagcggctacggcggcggcctcggagctggcctgggcggctacggcgcgccgggcgtggccggcctcggcgtgcctgggtcccccagcttcctcaatggctccaccgccacctcgcccttcgccatcatgccctctagccccccgctggcggctgcctcctccatgtccctcccggccgctgcccccaccaccagcgtgttctccttctcgcctgtcaacatgatctccgccgtcaaacagaggagcgccttcgcccccgtgctgcgccccccaagctccccaccccaggcctgccccagagcccacggagaggggcttccagaccagtcttttgaggattctgacaagtttcactctccagcccgggggcttcagggcctggcatactcctaattacggtctgcagctgttcccatggagcccggactggaggtccctctgggattcacagccacaccccggatggtggcacagacagatgcagggccagggccatgggcggacctcaacccgtgagctgaacggggagaggccttcaccccatgctcaagcctccccgctagcagccccacaggcttctctcgcctccctgtcttggggtagtcagaagccccagcactgtgcagatgctcttggcaggacagcatcgcagggaggtgctgggattctgggcctcactgtctgggtcttggttcctctgaaagagatggatcttgtgcagaccagggttgttgagtgaggggagcgtgggatggggaccgtgggaaagaggacagctcagggagaagtgacctggaaaggtcctgtttgcatctgacccatctcaactggcccagcatcccaacttctctgcagcgaaagggtggcgccccgcagcctcgggaggcctgcccaggctcccgtggagcttccaacagctgcttggccccgcagctgcccccacttcctttgagacctgcactctcatgcttgccgcatcatgcctccctgtgggggctttgggcatggaggaggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgcccgcccggcctctcacctgcctccttggtgtg

SEQ ID NO: 9195 - DNA, 3138 bp, Homo sapiens
gcgcgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgagccacaaagccaggccttcccgggctcggcagggacagcgctccagtacccgcctcctgcctaccctgccgccaagggtggcttccaggttcccatgatccccgactacctgtttccacagcagcagggggatctgggcctgggcaccccagaccagaagcccttccagggcctggagagccgcacccagcagccttcgctaacccctctgtctactattaaggcctttgccactcagtcgggctcccaggacctgaaggccctcaataccagctaccagtcccagctcatcaaacccagccgcatgcgcaagtaccccaaccggcccagcaagacgcccccccacgaacgcccttacgcttgcccagtggagtcctgtgatcgccgcttctcccgctccgacgagctcacccgccacatccgcatccacacaggccagaagcccttccagtgccgcatctgcatgcgcaacttcagccgcagcgaccacctcaccacccacatccgcacccacacaggcgaaaagcccttcgcctgcgacatctgtggaagaaagtttgccaggagcgatgaacgcaagaggcataccaagatccacttgcggcagaaggacaagaaagcagacaaaagtgttgtggcctcttcggccacctcctctctctcttcctacccgtccccggttgctacctcttacccgtccccggttactacctcttatccatccccggccaccacctcatacccatcccctgtgcccacctccttctcctctcccggctcctcgacctacccatcccctgtgcacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagagccaagtcctccctctctactggagtggaaggtctattggccaacaatcctttctgcccacttccccttccccaattactattccctttgacttcagctgcctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatatggtttggtttttctttttttttttttttgaaagtgttttttcttcgtccttttggtttaaaaagtttcacgtcttggtgccttttgtgtgatgcgccttgctgatggcttgacatgtgcaattgtgagggacatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggaatgttgtagttacctactgagtaggcggcgatttttgtatgttatgaacatgcagttcattattttgtggttctattttactttgtacttgtgtttgcttaaacaaagtgactgtttggcttataaacacattgaatgcgctttattgcccatgggatatgtggtgtatatccttccaaaaaattaaaacgaaaataaagtagctgcgattggg

SEQ ID NO: 9196 - DNA, 1005 bp, Homo sapiens
agagatcccagcgcgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcttcccctccccgtcggtggccaccacgtactcctctgttccccctgctttcccggcccaggtcagcagcttcccttcctcagctgtcaccaactccttcagcgcctccacagggctttcggacatgacagcaaccttttctcccaggacaattgaaatttgctaaagggaaaggggaaagaaagggaaaagggagaaaaagaaacacaagagacttaaaggacaggaggaggagatggccataggagaggagggttcctcttaggtcagatggaggttctcagag

SEQ ID NO: 9197 - DNA, 1406 bp, Homo sapiens
agagatcccagcgcgcagaacttggggagccgccgccgccatccgccgccgcagccagcttccgccgccgcaggaccggcccctgccccagcctccgcagccgcggcgcgtccacgcccgcccgcgcccagggcgagtcggggtcgccgcctgcacgcttctcagtgttccccgcgccccgcatgtaacccggccaggcccccgcaactgtgtcccctgcagctccagccccgggctgcacccccccgccccgacaccagctctccagcctgctcgtccaggatggccgcggccaaggccgagatgcagctgatgtccccgctgcagatctctgacccgttcggatcctttcctcactcgcccaccatggacaactaccctaagctggaggagatgatgctgctgagcaacggggctccccagttcctcggcgccgccggggccccagagggcagcggcagcaacagcagcagcagcagcagcgggggcggtggaggcggcgggggcggcagcaacagcagcagcagcagcagcaccttcaaccctcaggcggacacgggcgagcagccctacgagcacctgaccgcagagtcttttcctgacatctctctgaacaacgagaaggtgctggtggagaccagttaccccagccaaaccactcgactgccccccatcacctatactggccgcttttccctggagcctgcacccaacagtggcaacaccttgtggcccgagcccctcttcagcttggtcagtggcctagtgagcatgaccaacccaccggcctcctcgtcctcagcaccatctccagcggcctcctccgcctccgcctcccagagcccacccctgagctgcgcagtgccatccaacgacagcagtcccatttactcagcggcacccaccttccccacgccgaacactgacattttccctgaaacagccatgtccaagttcttcacctctatccaaagaacttgatttgcatggattttggataaatcatttcagtatcatctccatcatatgcctgaccccttgctcccttcaatgctagaaaatcgagttggcaaaatggggtttgggcccctcagagccctgccctgcacccttgtacagtgtctgtgccatggatttcgtttttcttggggtactcttgatgtgaagataatttgcatattctattgtattatttggagttaggtcctcacttgggggaaaaaaaaaaaagaaaagccaagcaaaccaatggtgatcctctattttgtgatgatgctgtgacaataagtttgaacctttttttttgaaacagcagtcccagtattctcagagcatgtgtcagagtgttgttccgttaacctttttgtaaatactgcttgaccgtactctcacatgtggcaaaatat

SEQ ID NO: 9198 - DNA, 2968 bp, Homo sapiens
gagcaattgattaatagctcggcgaggggactcactgactgttataataacactacaccagcaactcctggcttcccagcagccggaacacagacaggagagagtcagtggcaaatagacatttttcttatttcttaaaaaacagcaacttgtttgctacttttatttctgttgatttttttttcttggtgtgtgtggtggttgtttttaagtgtggagggcaaaaggagataccatcccaggctcagtccaacccctctccaaaacggcttttctgacactccaggtagcgagggagttgggtctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctatccgtcccccaagccagccacggacccaggtctcttcccaatgatcccagactatcctggattctttccatctcagtgccagagagacctacatggtacagctggcccagaccgtaagccctttccctgcccactggacaccctgcgggtgccccctccactcactccactctctacaatccgtaactttaccctggggggccccagtgctggggtgaccggaccaggggccagtggaggcagcgagggaccccggctgcctggtagcagctcagcagcagcagcagccgccgccgccgccgcctataacccacaccacctgccactgcggcccattctgaggcctcgcaagtaccccaacagacccagcaagacgccggtgcacgagaggccctacccgtgcccagcagaaggctgcgaccggcggttctcccgctctgacgagctgacacggcacatccgaatccacactgggcataagcccttccagtgtcggatctgcatgcgcaacttcagccgcagtgaccacctcaccacccatatccgcacccacaccggtgagaagcccttcgcctgtgactactgtggccgaaagtttgcccggagtgatgagaggaagcgccacaccaagatccacctgagacagaaagagcggaaaagcagtgccccctctgcatcggtgccagccccctctacagcctcctgctctgggggcgtgcagcctgggggtaccctgtgcagcagtaacagcagcagtcttggcggagggccgctcgccccttgctcctctcggacccggacaccttgagatgagactcaggctgatacaccagctcccaaaggtcccggaggccctttgtccactggagctgcacaacaaacactaccaccctttcctgtccctctctccctttgttgggcaaagggctttggtggagctagcactgccccctttccacctagaagcaggttcttcctaaaacttagcccattctagtctctcttaggtgagttgactatcaacccaaggcaaaggggaggctcagaaggaggtggtgtggggacccctggccaagagggctgaggtctgaccctgctttaaagggttgtttgactaggttttgctaccccacttccccttattttgacccatcacaggtttttgaccctggatgtcagagttgatctaagacgttttctacaataggttgggagatgctgatcccttcaagtggggacagcaaaaagacaagcaaaactgatgtgcactttatggcttgggactgatttgggggacattgtacagtgagtgaagtatagcctttatgccacactctgtggccctaaaatggtgaatcagagcatatctagttgtctcaacccttgaagcaatatgtattataaactcagagaacagaagtgcaatgtgatgggaggaacatagcaatatctgctccttttcgagttgtttgagaaatgtaggctattttttcagtgtatatccactcagattttgtgtatttttgatgtacactgttctctaaattctgaatctttgggaaaaaatgtaaagcatttatgatctcagaggttaacttatttaagggggatgtacatatattctctgaaactaggatgcatgcaattgtgttggaagtgtccttggtgccttgtgtgatgtagacaatgttacaaggtctgcatgtaaatgggttgccttattatggagaaaaaaaatcactccctgagtttagtatggctgtatatttctgcctattaatatttggaattttttttagaaagtatatttttgtatgctttgttttgtgacttaaaagtgttacctttgtagtcaaatttcagataagaatgtacataatgttaccggagctgatttgtttggtcattagctcttaatagttgtgaaaaaataaatctattctaacgcaaaaccactaactgaagttcagataatggatggtttgtgactatagtgtaaataaatacttttcaacaata

SEQ ID NO: 9199 - DNA, 2872 bp, Homo sapiens
aactgagcgaggagcaattgattaatagctcggcgaggggactcactgactgttataataacactacaccagcaactcctggcttcccagcagccggaacacagacaggagagagtcagtggcaaatagacatttttcttatttcttaaaaaacagcaacttgtttgctacttttatttctgttgatttttttttcttggtgtgtgtggtggttgtttttaagtgtggagggcaaaaggagataccatcccaggctcagtccaacccctctccaaaacggcttttctgacactccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctatccgtcccccaagccagccacggacccaggtctcttcccaatgatcccagactatcctggattctttccatctcagtgccagagagacctacatggtacagctggcccagaccgtaagccctttccctgcccactggacaccctgcgggtgccccctccactcactccactctctacaatccgtaactttaccctggggggccccagtgctggggtgaccggaccaggggccagtggaggcagcgagggaccccggctgcctggtagcagctcagcagcagcagcagccgccgccgccgccgcctataacccacaccacctgccactgcggcccattctgaggcctcgcaagtaccccaacagacccagcaagacgccggtgcacgagaggccctacccgtgcccagcagaaggctgcgaccggcggttctcccgctctgacgagctgacacggcacatccgaatccacactgggcataagcccttccagtgtcggatctgcatgcgcaacttcagccgcagtgaccacctcaccacccatatccgcacccacaccggtgagaagcccttcgcctgtgactactgtggccgaaagtttgcccggagtgatgagaggaagcgccacaccaagatccacctgagacagaaagagcggaaaagcagtgccccctctgcatcggtgccagccccctctacagcctcctgctctgggggcgtgcagcctgggggtaccctgtgcagcagtaacagcagcagtcttggcggagggccgctcgccccttgctcctctcggacccggacaccttgagatgagactcaggctgatacaccagctcccaaaggtcccggaggccctttgtccactggagctgcacaacaaacactaccaccctttcctgtccctctctccctttgttgggcaaagggctttggtggagctagcactgccccctttccacctagaagcaggttcttcctaaaacttagcccattctagtctctcttaggtgagttgactatcaacccaaggcaaaggggaggctcagaaggaggtggtgtggggacccctggccaagagggctgaggtctgaccctgctttaaagggttgtttgactaggttttgctaccccacttccccttattttgacccatcacaggtttttgaccctggatgtcagagttgatctaagacgttttctacaataggttgggagatgctgatcccttcaagtggggacagcaaaaagacaagcaaaactgatgtgcactttatggcttgggactgatttgggggacattgtacagtgagtgaagtatagcctttatgccacactctgtggccctaaaatggtgaatcagagcatatctagttgtctcaacccttgaagcaatatgtattataaactcagagaacagaagtgcaatgtgatgggaggaacatagcaatatctgctccttttcgagttgtttgagaaatgtaggctattttttcagtgtatatccactcagattttgtgtatttttgatgtacactgttctctaaattctgaatctttgggaaaaaatgtaaagcatttatgatctcagaggttaacttatttaagggggatgtacatatattctctgaaactaggatgcatgcaattgtgttggaagtgtccttggtgccttgtgtgatgtagacaatgttacaaggtctgcatgtaaatgggttgccttattatggagaaaaaaaatcactccctgagtttagtatggctgtatatttctgcctattaatatttggaattttttttagaaagtatatttttgtatgctttgttttgtgacttaaaagtgttacctttgtagtcaaatttcagataagaatgtacataatgttaccggagctgatttgtttggtcattagctcttaatagttgtgaaaaaataaatctattctaacgcaaaaccactaactgaagttcagataatggatggtttgtgactatagtgtaaataaatacttttc

SEQ ID NO: 9200 - DNA, 1190 bp, Homo sapiens
tttcggactcagggcccgagatgcgagtcggactcccttccgaggcgtcgtcttgcccatggtcagcgcgggggccgcgggacccgccagagcgcaggcggagtgggctggcgcacgtgctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctatccgtcccccaagccagtggaggcagcgagggaccccggctgcctggtagcagctcagcagcagcagcagccgccgccgccgccgcctataacccacaccacctgccactgcggcccattctgaggcctcgcaagtaccccaacagacccagcaagacgccggtgcacgagaggccctacccgtgcccagcagaaggctgcgaccggcggttctcccgctctgacgagctgacacggcacatccgaatccacactgggcataagcccttccagtgtcggatctgcatgcgcaacttcagccgcagtgaccacctcaccacccatatccgcacccacaccggtgagaagcccttcgcctgtgactactgtggccgaaagtttgcccggagtgatgagaggaagcgccacaccaagatccacctgagacagaaagagcggaaaagcagtgccccctctgcatcggtgccagccccctctacagcctcctgctctgggggcgtgcagcctg

SEQ ID NO: 9201 - DNA, 2844 bp, Homo sapiens
gatgcagcgtagctcttagggggaggtgtgagtccttggaaagctcacaagaatttcagaggggcccgagatgcgagtcggactcccttccgaggcgtcgtcttgcccatggtcagcgcgggggccgcgggacccgccagagcgcaggcggagtgggctggcgcacgtggtagcgagggagttgggtctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctatccgtcccccaagccagccacggacccaggtctcttcccaatgatcccagactatcctggattctttccatctcagtgccagagagacctacatggtacagctggcccagaccgtaagccctttccctgcccactggacaccctgcgggtgccccctccactcactccactctctacaatccgtaactttaccctggggggccccagtgctggggtgaccggaccaggggccagtggaggcagcgagggaccccggctgcctggtagcagctcagcagcagcagcagccgccgccgccgccgcctataacccacaccacctgccactgcggcccattctgaggcctcgcaagtaccccaacagacccagcaagacgccggtgcacgagaggccctacccgtgcccagcagaaggctgcgaccggcggttctcccgctctgacgagctgacacggcacatccgaatccacactgggcataagcccttccagtgtcggatctgcatgcgcaacttcagccgcagtgaccacctcaccacccatatccgcacccacaccggtgagaagcccttcgcctgtgactactgtggccgaaagtttgcccggagtgatgagaggaagcgccacaccaagatccacctgagacagaaagagcggaaaagcagtgccccctctgcatcggtgccagccccctctacagcctcctgctctgggggcgtgcagcctgggggtaccctgtgcagcagtaacagcagcagtcttggcggagggccgctcgccccttgctcctctcggacccggacaccttgagatgagactcaggctgatacaccagctcccaaaggtcccggaggccctttgtccactggagctgcacaacaaacactaccaccctttcctgtccctctctccctttgttgggcaaagggctttggtggagctagcactgccccctttccacctagaagcaggttcttcctaaaacttagcccattctagtctctcttaggtgagttgactatcaacccaaggcaaaggggaggctcagaaggaggtggtgtggggacccctggccaagagggctgaggtctgaccctgctttaaagggttgtttgactaggttttgctaccccacttccccttattttgacccatcacaggtttttgaccctggatgtcagagttgatctaagacgttttctacaataggttgggagatgctgatcccttcaagtggggacagcaaaaagacaagcaaaactgatgtgcactttatggcttgggactgatttgggggacattgtacagtgagtgaagtatagcctttatgccacactctgtggccctaaaatggtgaatcagagcatatctagttgtctcaacccttgaagcaatatgtattataaactcagagaacagaagtgcaatgtgatgggaggaacatagcaatatctgctccttttcgagttgtttgagaaatgtaggctattttttcagtgtatatccactcagattttgtgtatttttgatgtacactgttctctaaattctgaatctttgggaaaaaatgtaaagcatttatgatctcagaggttaacttatttaagggggatgtacatatattctctgaaactaggatgcatgcaattgtgttggaagtgtccttggtgccttgtgtgatgtagacaatgttacaaggtctgcatgtaaatgggttgccttattatggagaaaaaaaatcactccctgagtttagtatggctgtatatttctgcctattaatatttggaattttttttagaaagtatatttttgtatgctttgttttgtgacttaaaagtgttacctttgtagtcaaatttcagataagaatgtacataatgttaccggagctgatttgtttggtcattagctcttaatagttgtgaaaaaataaatctattctaacgcaaaaccactaactgaagttcagataatggatggtttgtgactatagtgtaaataaatacttttc

SEQ ID NO: 9202 - DNA, 2372 bp, Homo sapiens
ttttcgggagtccccggcacacatcctgtgtccatgtttgggcatttacgtcacggcggcagggccggggcctcccaaaatggcagtggcccggggagtcggaagcccggagccagcgccgccgcagctatataagtgggggggctgtgggctgggggagcccggcagcgctttggagaggcgaggagccgccgcccgaggccggtgcgggcgagcgagggcgccgcggctccccgactcctttcccagaggtgagtgcccgaagccaggagcccgggcgcctaggtctgtgcgctgcggggaacccctaccgccagcctccccgccacccgcgcgcccccaagcccagcgggcgaggccccgggcgccccacagccggcgccgcgccatgctccaccttagcgagttttccgaacccgacgcgctcctcgtcaagtccactgaaggctgttgcgccgaacccagcgctgaattgccccggctgcctgccagggacgctcccgcggccaccggctaccctggagcaggcgacttcttgagctgggctttgaacagctgcggcgcaagtggggacttagccgactcctgcttcctggaggggcctgcgcccacaccccctcccggcctcagctacagcggtagcttcttcattcaggcagtgcccgaacacccgcacgacccggaggcactcttcaacctcatgtcgggcatcttaggcctggcacccttccccggtccagaggcagcagcgtccagatccccgctggatgccccttttcctgcggggtccgatgccttgctgccgggtccgccggacctttactccccggatctgggcgctgcccctttcccagaggcgttctgggaggcctcgccttgcgcgggtgccccctcgcagtgcctgtatgagcctcagctctccccgcccgacgtcaagcccggcctccgggcgcctcccgcctcgccagcgctggacgctgtctctgccttcaagggtccctacgcgccctgggagctgctttctgtgggggccccagggaactgtgggtcacagggagactaccaggccgccccggaggctcgttttcccgtaatagggaccaagattgaggacttgctgtccatcagctgccctgcggaactgccggccgtcccagccaacagactctatcccagcggggcctatgacgctttcccgctggccccgggtgacttaggggagggggctgagggcctccctgggctcctgacccctcctagtggggagggagggagtagcggcgacggcggagagtttctggccagtacgcagcctcagctttccccgctgggccttcgcagcgccgccgcggcggacttccctaaacctctggtggcggacatccctggaagcagtggcgtggctgcaccacccgtgccgccgccgccgcccacccctttcccccaggccaaggcgcgacgcaaggggcgccgcggcggcaaatgcagcacgcgctgcttctgcccgcggccgcacgccaaggccttcgcttgcccggtggagagttgtgtgcggagctttgcgcgctccgacgagctcaatcgccacctgcgcatccacacgggccacaaacccttccagtgccgcatctgcctccgcaacttcagccgcagcgaccacctcaccacgcacgtgcgcacccacaccggcgagaagccttttgcttgcgacgtgtgcggccgccgcttcgcgcgcagcgatgagaagaaacggcacagcaaggtgcacctcaagcagaaggcgcgcgccgaggagcggctcaagggcctcggcttttactcgctgggcctctccttcgcttctctctgagcaagagatgggtttatgggttggggcgccgccgttcggcgcgcacgagttccgggccgttcccctccccgctcttcttccaactcctcctcgcacgcccgagggccggcctccggtcccgcttccagtttccttgaagcgcccgccgcacacgccctattcagcaccagctccgcggacagttcccgcggtccaggcgctgtcacccttgtcagccgcgctttgggggaagtcttctgagaccacccagtgaataggcactaccctgggattcaagacagtcttttgtaactggcacacgccccacgccttcctctataacccccagagacaggctggggcagcgccaaggcggtctcgcgcgggactttgtacagcagtgtcttatccagcagccattggatgtaacgttttgctttgggttttttttccttttgttgttgttaatttttgtaaagcagacgctactctcaagcagttgacaaaactgtttatttttgcaattaaaattattgtgctaaaa

SEQ ID NO: 9203 - DNA, 2372 bp, Homo sapiens
cgggagtccccggcacacatcctgtgtccatgtttgggcatttacgtcacggcggcagggccggggcctcccaaaatggcagtggcccggggagtcggaagcccggagccagcgccgccgcagctatataagtgggggggctgtgggctgggggagcccggcagcgctttggagaggcgaggagccgccgcccgaggccggtgcgggcgagcgagggcgccgcggctccccgactcctttcccagaggtgagtgcccgaagccaggagcccgggcgcctaggtctgtgcgctgcggggaacccctaccgccagcctccccgccacccgcgcgcccccaagcccagcgggcgaggccccgggcgccccacagccggcgccgcgccatgctccaccttagcgagttttccgaacccgacgcgctcctcgtcaagtccactgaaggctgttgcgccgaacccagcgctgaattgccccggctgcctgccagggacgctcccgcggccaccggctaccctggagcaggcgacttcttgagctgggctttgaacagctgcggcgcaagtggggacttagccgactcctgcttcctggaggggcctgcgcccacaccccctcccggcctcagctacagcggtagcttcttcattcaggcagtgcccgaacacccgcacgacccggaggcactcttcaacctcatgtcgggcatcttaggcctggcacccttccccggtccagaggcagcagcgtccagatccccgctggatgccccttttcctgcggggtccgatgccttgctgccgggtccgccggacctttactccccggatctgggcgctgcccctttcccagaggcgttctgggaggcctcgccttgcgcgggtgccccctcgcagtgcctgtatgagcctcagctctccccgcccgacgtcaagcccggcctccgggcgcctcccgcctcgccagcgctggacgctgtctctgccttcaagggtccctacgcgccctgggagctgctttctgtgggggccccagggaactgtgggtcacagggagactaccaggccgccccggaggctcgttttcccgtaatagggaccaagattgaggacttgctgtccatcagctgccctgcggaactgccggccgtcccagccaacagactctatcccagcggggcctatgacgctttcccgctggccccgggtgacttaggggagggggctgagggcctccctgggctcctgacccctcctagtggggagggagggagtagcggcgacggcggagagtttctggccagtacgcagcctcagctttccccgctgggccttcgcagcgccgccgcggcggacttccctaaacctctggtggcggacatccctggaagcagtggcgtggctgcaccacccgtgccgccgccgccgcccacccctttcccccaggccaaggcgcgacgcaaggggcgccgcggcggcaaatgcagcacgcgctgcttctgcccgcggccgcacgccaaggccttcgcttgcccggtggagagttgtgtgcggagctttgcgcgctccgacgagctcaatcgccacctgcgcatccacacgggccacaaacccttccagtgccgcatctgcctccgcaacttcagccgcagcgaccacctcaccacgcacgtgcgcacccacaccggcgagaagccttttgcttgcgacgtgtgcggccgccgcttcgcgcgcagcgatgagaagaaacggcacagcaaggtgcacctcaagcagaaggcgcgcgccgaggagcggctcaagggcctcggcttttactcgctgggcctctccttcgcttctctctgagcaagagatgggtttatgggttggggcgccgccgttcggcgcgcacgagttccgggccgttcccctccccgctcttcttccaactcctcctcgcacgcccgagggccggcctccggtcccgcttccagtttccttgaagcgcccgccgcacacgccctattcagcaccagctccgcggacagttcccgcggtccaggcgctgtcacccttgtcagccgcgctttgggggaagtcttctgagaccacccagtgaataggcactaccctgggattcaagacagtcttttgtaactggcacacgccccacgccttcctctataacccccagagacaggctggggcagcgccaaggcggtctcgcgcgggactttgtacagcagtgtcttatccagcagccattggatgtaacgttttgctttgggttttttttccttttgttgttgttaatttttgtaaagcagacgctactctcaagcagttgacaaaactgtttatttttgcaattaaaattattgtgctaaaagctt

SEQ ID NO: 9204 - DNA, 1322 bp, Homo sapiens
gcgattcggtggcacgtggagccacggcgtgggagtagggggctgaaggcaggcagcagcggccagggccgccctctgctagccgcttgggtctcgggataccccgtttcttcctgtaggtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacacatacctttggttaaatagtctagactaaaagattgagaagttactttccattgctatctattgataatttagacattgagttcaaattgccttcattttatgataaataatgatttaactga

SEQ ID NO: 9205 - DNA, 1503 bp, Homo sapiens
cctcccccggggtcctcctccgcgccaccccacccccgcggctcctttttctgccttttcctttgtaccctcactgctaccagctccttctggcgacccccaggtaccccctcccacctttcgtttctctctgggtcagcagaccacgcatgtatccagaggcgctacctgtagggatcctaagcaacccggacactttcaaacgccgtagcggttcctatagcaacgacaaaccggaagtatggtttgccgccggaagcggaagtcccaatcaaaagttgagcagtagctgtgtgggacgtgcgtgcggcgagatggacactcccccgctctcggattcggagtcggaatccgatgaatcccttgtcacagacagagagttgcaggatgcgttttcccgagggcttctgaagccaggcctcaatgtcgtgctagaggggccgaagaaggccgtgaacgacgtgaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttctatcgccaagcccaggccgcagtgcttgcagtcttaccccgcctccatcagctcaaagtccctacgaagcgacccactgattattttgcggaaatggccaaatctgatctgcagatgcagaagattcgacagaagctgcagactaaacaggctgccatggagaggtctgaaaaagctaagcaactgcgagcacttaggaaatacgggaagaaggtgcaaacggaggttcttcagaagaggcagcaggagaaagcccatatgatgaatgctattaagaaatatcagaaaggcttctctgataaactggatttccttgagggagatcagaaacctctggcacagcgcaagaaggcaggagccaaaggccagcagatgaggaaggggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaataagagacctggaaaacgaacaagagagaagatgaagaacagaacacactaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacacatacctttggttaaatagtctagactaaaagattgagaagttactttccattgctatctattgataatttagacattgagttcaaattgccttcattttatgataaataatgatttaactgacaccttctc

SEQ ID NO: 9206 - DNA, 4535 bp, Homo sapiens
atggtaaccggcagcagcagccgccacagcagggccggccccagcgccagcgccggtcgcggtcgggctcagctcagtgtgtggtgagcggcggcggcgcggccgggccggggagcgggcgcggcccggcggcctcagcatggaggacggcttctccagctacagcagcctgtacgacacgtcctcgctgctccagttctgcaacgatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaagcaagaccactgatgcagaccctgcctttaagaaccacggtcaacaatggcactgtgttaccaaagaaacctactggctctctaccatccccctccggggtcaggaaagaaactgctgtgccagcaaccaaaagtaacatcaagaggaccagctcttctgaacgagtgtctcctgggggtcgaagggaaagcaatggggattccagaggaaaccggaatcgcacaggctccaccagcagctcttccagtggcaaaaagaacagtgaaagcaaacccaaggagcctgtattcagtgcagaagaaggctatgtaaaaatgtttcttcgtggacgccctgttaccatgtacatgcccaaagatcaagtggattcttacagcttggaagcaaaagtagaacttccaaccaagagactcaagctggaatgggtctatgggtacaggggtcgagactgccgtaacaacctgtacttgcttccgacgggagagaccgtctacttcatcgcatccgtggtggtgttatacaacgtggaggagcaactgcagaggcattacgctggccacaacgatgacgtgaagtgcctagcagttcatcctgatcggatcacgatagcaacaggacaagttgcgggcacatcgaaggatggaaaacaattgcccccacatgtgcgcatctgggattctgtgacattgaatactctccacgtcattggaataggtttttttgaccgagcagtcacctgtattgcattctcaaaatctaatggaggaaccaatctctgtgctgtggatgactccaacgaccatgtgctctctgtatgggactggcagaaagaagaaaaactagcagatgtgaagtgctctaatgaagctgtgtttgctgcggatttccaccccacggacaccaacatcatagttacttgtggaaaatcacatctctacttttggacactagaaggaagctcccttaataagaagcaaggattattcgagaaacaagaaaagccaaagtttgtcctctgtgtgactttctctgaaaacggtgacaccattactggagattcaagtggcaacatcttagtatggggaaaaggtacaaatcgaataagctatgcagttcagggggcccatgagggtggcatttttgcactttgtatgttaagagatggcacactggtgtcgggaggtgggaaagaccgaaagctcatttcttggagcggaaactatcaaaaacttcgtaaaacggagattccagaacagtttggtccaatacggacagtggccgaggggaaaggcgatgtgatcttgattggcacaactcgaaactttgtcctgcagggcactctgtcaggggacttcacacccattactcagggtcacactgatgagctctggggactggccatccatgcctcaaaatctcagttcttgacctgtgggcatgacaagcatgccactctctgggacgctgtgggtcaccgtcccgtctgggacaaaataatagaggatccagctcagtcttctggttttcatccttcagggtctgtggttgcagtcggaacactcactgggaggtggtttgtgtttgacacagaaacaaaagacttggtcaccgttcacacagatggaaacgaacagctctctgtaatgcgatactcaccagatgggaatttcttagccataggctcacatgacaactgcatctatatatatggcgttagtgacaacgggaggaagtacacgcgagtgggcaagtgctcgggtcattccagcttcattactcacctggactggtctgtaaactcacagttcctcgtgtcaaattccggagactacgaaatcctctactgggttccctctgcctgtaagcaagtcgtaagtgtggaaactacaagagacattgaatgggctacctatacctgcactttgggattccatgtttttggagtgtggccagaaggctcggacggaaccgacatcaatgccgtctgtcgggcccatgagaagaaactcctgtcaacaggcgacgactttggcaaagtgcacctcttctcatacccctgctcgcagttcagggctccaagccacatctacggcgggcacagcagccatgtcaccaatgtcgatttcctctgtgaagacagccacctcatctccacgggcgggaaagacacaagcatcatgcagtggcgcgtcatttagtacccaccgagagctgtggggagcagcatgggcaaggaagacacagactcgcattacccttggtcactgtgatttctgttttgtttaaaaaattcttacaaacctcaggaaaactgtgccctccgccggctaccttagcttagcgtgtcagcgggcgccacagcggatcagcggttccgtgttcacttttgttgtacaatatatgacacagtgcacattgaataccaacaaggttgcaacgtttacattatagccacatcaacagaagtaactggtatattcttagtaacttttctatgaactcttcaaaaatggtcacagaatgccttttaaaacattgtatataatcttcactgtttcaccatctagcttgctaagtcaaatatttatgatgataatgaggtactgaaccacgatggctgttgaggaattggtcctaaaaggacagatcacttcagaagagtgaataactgatttgcacagctgaatcaggagacacaaagatgagactgtgtttggttacattttccaaagtttcattgcattctcccttggggaggctgtgagagagggcttgtatccctcttgtgctaagcagactctactcctaactgacttcaatatttcagcagggtacacaggcgtttccaagtttcagtgacaccgtcctgcctaaccagatgcggtcagcctcttcacacccacctggcttgcatcccccatcccttgttcacacgccctgattcacggtgagacattttgccaccttcttgtgtatattacttggcatgagatgatattgtacttgtataggattctagcaattcataataaatatgtaagactaggctttactgtcttatgcttatggacattgtatatttgtattttatgaccaagtagaccaagtcagaaagatctctctcgagcgtaccataaacctgcagagagaagtctcgaaaggctccaccaggtaccaagggcagctgcttttcctgtcttttgtgcatgggcgacccattacagtatgagataagattgagttctgatgcgttaaacggaggtggcagaaatttgtcaagaaggccttatccatttcgattgtgtgacagattgaaatttattgtttacattggggaatgtatctcaaatttttaaatagaagagtaataaacagactttaaagcaaatattaagatttttactcattcaaggcaagtaaatgaatggaattatctgagctctatggcactggttgtttagagtgactgatgaagtgcaactttcaaaaacatttttgatgacatcaccagcctactgcagaagtgcagggcaccagtaaacaccatgtattattgaagatgaatctgtttgtatgtatccttgtcaaatatattctataatgaaataaaatctgaaaagtggatttcttattgacctatattcatgaaagcatataaattaaaatatttaaaattagatatgattcacactatattctgtttcatatgcagattttattctcacctgggccatttgcagatgagactgtagtttgcagatgagactgtagtttgcagatggcgtggaagcattcatcaggggagataaccataaaggatttggcctaattaccatactcaattgtcagtttacgtggttttgtgaatactggcaaaagcaattgtttttaaattaacaatggagagaatgataagatgagggaaggaaaaggcattcattattgacttacatgtcagtaaggtctgcttttatttctatgtactcctgtttgccaagctcaataatggacaaaggatacaaacacacacacatctactattttagataaatgtactgttatatatatatgtaaactactattgctctctttataatgattaatcactttattatgaatgaatgaatgaatttgatggatttaaaa

SEQ ID NO: 9207 - DNA, 4064 bp, Homo sapiens
aaccggcagcagcagccgccacagcagggccggccccagcgccagcgccggtcgcggtcgggctcagctcagtgtgtggtgagcggcggcggcgcggccgggccggggagcgggcgcggcccggcggcctcagcatggaggacggcttctccagctacagcagcctgtacgacacgtcctcgctgctccagttctgcaacgatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaagcaagaccactgatgcagaccctgcctttaagaaccacggtcaacaatggcactgtgttaccaaagaaacctactggctctctaccatccccctccggggtcaggaaagaaactgctgtgccagcaaccaaaagattaaacagatctgtgagtcttctcaatgcttgcaaactgaatagatcgacaccaagtaacatcaagaggaccagctcttctgaacgagtgtctcctgggggtcgaagggaaagcaatggggattccagaggaaaccggaatcgcacaggctccaccagcagctcttccagtggcaaaaagaacagtgaaagcaaacccaaggagcctgtattcagtgcagaagaaggctatgtaaaaatgtttcttcgtggacgccctgttaccatgtacatgcccaaagatcaagtggattcttacagcttggaagcaaaagtagaacttccaaccaagagactcaagctggaatgggtctatgggtacaggggtcgagactgccgtaacaacctgtacttgcttccgacgggagagaccgtctacttcatcgcatccgtggtggtgttatacaacgtggaggagcaactgcagaggcattacgctggccacaacgatgacgtgaagtgcctagcagttcatcctgatcggatcacgatagcaacaggacaagttgcgggcacatcgaaggatggaaaacaattgcccccacatgtgcgcatctgggattctgtgacattgaatactctccacgtcattggaataggtttttttgaccgagcagtcacctgtattgcattctcaaaatctaatggaggaaccaatctctgtgctgtggatgactccaacgaccatgtgctctctgtatgggactggcagaaagaagaaaaactagcagatgtgaagtgctctaatgaagctgtgtttgctgcggatttccaccccacggacaccaacatcatagttacttgtggaaaatcacatctctacttttggacactagaaggaagctcccttaataagaagcaaggattattcgagaaacaagaaaagccaaagtttgtcctctgtgtgactttctctgaaaacggtgacaccattactggagattcaagtggcaacatcttagtatggggaaaaggtacaaatcgaataagctatgcagttcagggggcccatgagggtggcatttttgcactttgtatgttaagagatggcacactggtgtcgggaggtgggaaagaccgaaagctcatttcttggagcggaaactatcaaaaacttcgtaaaacggagattccagaacagtttggtccaatacggacagtggccgaggggaaaggcgatgtgatcttgattggcacaactcgaaactttgtcctgcagggcactctgtcaggggacttcacacccattactcagggtcacactgatgagctctggggactggccatccatgcctcaaaatctcagttcttgacctgtgggcatgacaagcatgccactctctgggacgctgtgggtcaccgtcccgtctgggacaaaataatagaggatccagctcagtcttctggttttcatccttcagggtctgtggttgcagtcggaacactcactgggaggtggtttgtgtttgacacagaaacaaaagacttggtcaccgttcacacagatggaaacgaacagctctctgtaatgcgatactcaccagatgggaatttcttagccataggctcacatgacaactgcatctatatatatggcgttagtgacaacgggaggaagtacacgcgagtgggcaagtgctcgggtcattccagcttcattactcacctggactggtctgtaaactcacagttcctcgtgtcaaattccggagactacgaaatcctctactgggttccctctgcctgtaagcaagtcgtaagtgtggaaactacaagagacattgaatgggctacctatacctgcactttgggattccatgtttttggagtgtggccagaaggctcggacggaaccgacatcaatgccgtctgtcgggcccatgagaagaaactcctgtcaacaggcgacgactttggcaaagtgcacctcttctcatacccctgctcgcagttcagggctccaagccacatctacggcgggcacagcagccatgtcaccaatgtcgatttcctctgtgaagacagccacctcatctccacgggcgggaaagacacaagcatcatgcagtggcgcgtcatttagtacccaccgagagctgtggggagcagcatgggcaaggaagacacagactcgcattacccttggtcactgtgatttctgttttgtttaaaaaattcttacaaacctcaggaaaactgtgccctccgccggctaccttagcttagcgtgtcagcgggcgccacagcggatcagcggttccgtgttcacttttgttgtacaatatatgacacagtgcacattgaataccaacaaggttgcaacgtttacattatagccacatcaacagaagtaactggtatattcttagtaacttttctatgaactcttcaaaaatggtcacagaatgccttttaaaacattgtatataatcttcactgtttcaccatctagcttgctaagtcaaatatttatgatgataatgaggtactgaaccacgatggctgttgaggaattggtcctaaaaggacagatcacttcagaagagtgaataactgatttgcacagctgaatcaggagacacaaagatgagactgtgtttggttacattttccaaagtttcattgcattctcccttggggaggctgtgagagagggcttgtatccctcttgtgctaagcagactctactcctaactgacttcaatatttcagcagggtacacaggcgtttccaagtttcagtgacaccgtcctgcctaaccagatgcggtcagcctcttcacacccacctggcttgcatcccccatcccttgttcacacgccctgattcacggtgagacattttgccaccttcttgtgtatattacttggcatgagatgatattgtacttgtataggattctagcaattcataataaatatgtaagactaggctttactgtcttatgcttatggacattgtatatttgtattttatgaccaagtagaccaagtcagaaagatctctctcgagcgtaccataaacctgcagagagaagtctcgaaaggctccaccaggtaccaagggcagctgcttttcctgtcttttgtgcatgggcgacccattacagtatgagataagattgagttctgatgcgttaaacggaggtggcagaaatttgtcaagaaggccttatccatttcgattgtgtgacagattgaaatttattgtttacattggggaatgtatctcaaatttttaaatagaagagtaataaacagactttaaagcaaatattaagatttttactcattcaaggcaagtaaatgaatggaattatctgagctctatggcactggttgtttagagtgactgatgaagtgcaactttcaaaaacatttttgatgacatcaccagcctactgcagaagtgcagggcaccagtaaacaccatgtattattgaagatgaatctgtttgtatgtatccttgtcaaatatattctataatgaaataaaatctgaaaagtgg

SEQ ID NO: 9208 - DNA, 3955 bp, Homo sapiens
agcgccggtcgcggtcgggctcagcatggaggacggcttctccagctacagcagcctgtacgacacgtcctcgctgctccagttctgcaacgatgacagcgcttctgctgcaagtagcatggaggtgacagaccgcattgcttcactggagcagagagtccagatgcaagaagacgacatccagctgctcaaatcagctctagctgatgtggttcggcggctgaacattactgaggaacagcaggccgtgcttaacaggaaaggacctaccaaagcaagaccactgatgcagaccctgcctttaagaaccacggtcaacaatggcactgtgttaccaaagaaacctactggctctctaccatccccctccggggtcaggaaagaaactgctgtgccagcaaccaaaagattaaacagatctgtgagtcttctcaatgcttgcaaactgaatagatcgacaccaagtaacatcaagaggaccagctcttctgaacgagtgtctcctgggggtcgaagggaaagcaatggggattccagaggaaaccggaatcgcacaggctccaccagcagctcttccagtggcaaaaagaacagtgaaagcaaacccaaggagcctgtattcagtgcagaagaaggctatgtaaaaatgtttcttcgtggacgccctgttaccatgtacatgcccaaagatcaagtggattcttacagcttggaagcaaaagtagaacttccaaccaagagactcaagctggaatgggtctatgggtacaggggtcgagactgccgtaacaacctgtacttgcttccgacgggagagaccgtctacttcatcgcatccgtggtggtgttatacaacgtggaggagcaactgcagaggcattacgctggccacaacgatgacgtgaagtgcctagcagttcatcctgatcggatcacgatagcaacaggacaagttgcgggcacatcgaaggatggaaaacaattgcccccacatgtgcgcatctgggattctgtgacattgaatactctccacgtcattggaataggtttttttgaccgagcagtcacctgtattgcattctcaaaatctaatggaggaaccaatctctgtgctgtggatgactccaacgaccatgtgctctctgtatgggactggcagaaagaagaaaaactagcagatgtgaagtgctctaatgaagctgtgtttgctgcggatttccaccccacggacaccaacatcatagttacttgtggaaaatcacatctctacttttggacactagaaggaagctcccttaataagaagcaaggattattcgagaaacaagaaaagccaaagtttgtcctctgtgtgactttctctgaaaacggtgacaccattactggagattcaagtggcaacatcttagtatggggaaaaggtacaaatcgaataagctatgcagttcagggggcccatgagggtggcatttttgcactttgtatgttaagagatggcacactggtgtcgggaggtgggaaagaccgaaagctcatttcttggagcggaaactatcaaaaacttcgtaaaacggagattccagaacagtttggtccaatacggacagtggccgaggggaaaggcgatgtgatcttgattggcacaactcgaaactttgtcctgcagggcactctgtcaggggacttcacacccattactcagggtcacactgatgagctctggggactggccatccatgcctcaaaatctcagttcttgacctgtgggcatgacaagcatgccactctctgggacgctgtgggtcaccgtcccgtctgggacaaaataatagaggatccagctcagtcttctggttttcatccttcagggtctgtggttgcagtcggaacactcactgggaggtggtttgtgtttgacacagaaacaaaagacttggtcaccgttcacacagatggaaacgaacagctctctgtaatgcgatactcaccagatgggaatttcttagccataggctcacatgacaactgcatctatatatatggcgttagtgacaacgggaggaagtacacgcgagtgggcaagtgctcgggtcattccagcttcattactcacctggactggtctgtaaactcacagttcctcgtgtcaaattccggagactacgaaatcctctactgggttccctctgcctgtaagcaagtcgtaagtgtggaaactacaagagacattgaatgggctacctatacctgcactttgggattccatgtttttggagtgtggccagaaggctcggacggaaccgacatcaatgccgtctgtcgggcccatgagaagaaactcctgtcaacaggcgacgactttggcaaagtgcacctcttctcatacccctgctcgcagttcagggctccaagccacatctacggcgggcacagcagccatgtcaccaatgtcgatttcctctgtgaagacagccacctcatctccacgggcgggaaagacacaagcatcatgcagtggcgcgtcatttagtacccaccgagagctgtggggagcagcatgggcaaggaagacacagactcgcattacccttggtcactgtgatttctgttttgtttaaaaaattcttacaaacctcaggaaaactgtgccctccgccggctaccttagcttagcgtgtcagcgggcgccacagcggatcagcggttccgtgttcacttttgttgtacaatatatgacacagtgcacattgaataccaacaaggttgcaacgtttacattatagccacatcaacagaagtaactggtatattcttagtaacttttctatgaactcttcaaaaatggtcacagaatgccttttaaaacattgtatataatcttcactgtttcaccatctagcttgctaagtcaaatatttatgatgataatgaggtactgaaccacgatggctgttgaggaattggtcctaaaaggacagatcacttcagaagagtgaataactgatttgcacagctgaatcaggagacacaaagatgagactgtgtttggttacattttccaaagtttcattgcattctcccttggggaggctgtgagagagggcttgtatccctcttgtgctaagcagactctactcctaactgacttcaatatttcagcagggtacacaggcgtttccaagtttcagtgacaccgtcctgcctaaccagatgcggtcagcctcttcacacccacctggcttgcatcccccatcccttgttcacacgccctgattcacggtgagacattttgccaccttcttgtgtatattacttggcatgagatgatattgtacttgtataggattctagcaattcataataaatatgtaagactaggctttactgtcttatgcttatggacattgtatatttgtattttatgaccaagtagaccaagtcagaaagatctctctcgagcgtaccataaacctgcagagagaagtctcgaaaggctccaccaggtaccaagggcagctgcttttcctgtcttttgtgcatgggcgacccattacagtatgagataagattgagttctgatgcgttaaacggaggtggcagaaatttgtcaagaaggccttatccatttcgattgtgtgacagattgaaatttattgtttacattggggaatgtatctcaaatttttaaatagaagagtaataaacagactttaaagcaaatattaagatttttactcattcaaggcaagtaaatgaatggaattatctgagctctatggcactggttgtttagagtgactgatgaagtgcaactttcaaaaacatttttgatgacatcaccagcctactgcagaagtgcagggcaccagtaaacaccatgtattattgaagatgaatctgtttgtatgtatccttgtcaaatatattctataatgaaataaaatctgaaaagtgg

SEQ ID NO: 9209 - DNA, 5549 bp, Homo sapiens
ggcgcggcgctcgcggctgctgcctgggagggaggccgggcaggcggctgagcggcgcggctctcaacgtgacggggaagtggttcgggcggccgcggcttactaccccagggcgaacggacggacgacggaggcgggagccggtagccgagccgggcgacctagagaacgagcgggtcaggctcagcgtcggccactctgtcggtccgctgaatgaagtgcccgcccctctaagcccggagcccggcgctttccccgcaagatggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagaaggagaatatattaaaatgtttatgcgcggtcggccaattaccatgttcattccttccgatgttgacaactatgatgacatcagaacggaactgcctcctgagaagctcaaactggagtgggcatatggttatcgaggaaaggactgtagagctaatgtttaccttcttccgaccgggaaaatagtttatttcattgcatcagtagtagtactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtattattgatgactccaatgagcatatgcttactgtatgggactggcagaagaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagaggttcctgatcagtatggcacaatcagagctgtagcagaaggaaaggcagatcaatttttagtaggcacatcacgaaactttattttacgaggaacatttaatgatggcttccaaatagaagtacagggtcatacagatgagctttggggtcttgccacacatcccttcaaagatttgctcttgacatgtgctcaggacaggcaggtgtgcctgtggaactcaatggaacacaggctggaatggaccaggctggtagatgaaccaggacactgtgcagattttcatccaagtggcacagtggtggccataggaacgcactcaggcaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatatagcagatatggaaggtgcactggacattccagctacatcacacaccttgactggtccccagacaacaagtatataatgtctaactcgggagactatgaaatattgtactgggacattccaaatggctgcaaactaatcaggaatcgatcggattgtaaggacattgattggacgacatatacctgtgtgctaggatttcaagtatttggtgtctggccagaaggatctgatgggacagatatcaatgcactggtgcgatcccacaatagaaaggtgatagctgttgccgatgacttttgtaaagtccatctgtttcagtatccctgctccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccagaaaaaaatgtactcttactgagataccctctcaccccaaatgtgtaatggaaaatttttaattaagaaaaacttcagttttgccaagtgcaatggtgttgccttctttaaaaaatgccgttttcttacactaccagtggatgtccagacatgctcttagtctactagagaggtgctgccttttctaagtcataatgaggaacagtcccttaatttcttgtgtgcaactctgttttatcctagaactaagagagcattggtttgttaaagagctttcaatgtatattaaaaccttcaatactcagaaatgatggattcctccaaggagtcctttactagcctaaacattctcaaatgtttgagattcaagtgaatggaaggaaaaccacatgcctttaaaactaaactgtaataattacctggctaatttcagctaagccttcatcataatttgttccctcagtaataggagaaatataaatacagtaagtttagattattgaattggtgcttgaaatttattggttttgttgtaattttatacagattatatgagggataagatactcatcaaattgcaaattcttttttttacagaagtgtgggtaacagtcacagcagttttttttaccaacagcatacttaacagacttgctgtgtagcagtttttttctggtggagttgctgtaagtcttgtaagtctaatgtggctatcctactcttttgggcaatgcatgtattatgcattggaaaggtattttttttaagttctgttggctagctatggttttcagtacatttcctactttaagagtaattactgacaaatatgtatttcctatatgtttatactttgattataaaaaagtattttgttttgattttttaacttgctgcattgttttgatactttctatttttttggtcaaatcatgtttagaaactttggatgagttaagaagtcttaagtatgcaggcgtttacgtgattgtgccattccaaagtgcatcagaactgtcattcccttctaatatcttctcaggagtaatacaaatcaggtatttcatcatcatttggtaatatgaaaactccagtgaactcccaaggacatttacaacatttatattcacacgctgtatggaagggtgtgggtgtgtgtgaaggggcgagtggagacactgtgtgtatctctagataagaagatatgcaccacgttgaaaatactcagtgtagatctctatgtgtataggtatctgtatatctttccttttgtttacaactgttaaaaaacctcaaaatagttctcttcaaaagaagagagattccaagcaacccatctttcttcagtatgtatgttctgtacatacttatcggagcgcgccagtaagtatcaggcatatatatctgtctgttagcaatgattattacatcatcagatcagcatgtgctatactccctgcaagaaatatactgacatgaacaggcagttcttggagaagaaagagcatttctttaagtacctggggaatacagctctcagtgatcagcagggagtttatttgaggacatcagtcacctttggggttgccatgtacaatgagatttataatcatgatactcttcggtggtagtttcaaaagacactactaatacgcaggaagcgttccagctatttaatgctggcaactactgtttaatggtcagttaaatctgtgataatggttggaagtgggtggggttatgaaattgtagatgtttttagaaaaacttgtgaatgaaaatgaatccaagtgtttcatgtgaagatgttgagccattgctatcatgcattcctgtctcatggcagaaaattttgaagattaaaaaataaaataatcaaaatgtttcctctttctaa

SEQ ID NO: 9210 - DNA, 1455 bp, Homo sapiens
tcagcaaacaaatcaaagctcatgatggcagtgtgttcacactttgtcagatgagaaatgggatgttattaactggaggagggaaagacagaaaaataattctgtgggatcatgatctgaatcctgaaagagaaatagaggttcctgatcagtatggcacaatcagagctgtagcagaaggaaaggcagatcaatttttagtaggcacatcacgaaactttattttacgaggaacatttaatgatggcttccaaatagaagtacagggtcatacagatgagctttggggtcttgccacacatcccttcaaagatttgctcttgacatgtgctcaggacaggcaggtgtgcctgtggaactcaatggaacacaggctggaatggaccaggctggtagatgaaccaggacactgtgcagattttcatccaagtggcacagtggtggccataggaacgcactcaggcagggacattccagctacatcacacaccttgactggtccccagacaacaagtatataatgtctaactcgggagactatgaaatattgtactgggacattccaaatggctgcaaactaatcaggaatcgatcggattgtaaggacattgattggacgacatatacctgtgtgctaggatttcaagtatttggtgtctggccagaaggatctgatgggacagatatcaatgcactggtgcgatcccacaatagaaaggtgatagctgttgccgatgacttttgtaaagtccatctgtttcagtatccctgctccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaa

SEQ ID NO: 9211 - DNA, 3568 bp, Homo sapiens
gcggcgctcgcggctgctgcctgggagggaggccgggcaggcggctgagcggcgcggctctcaacgtgacggggaagtggttcgggcggccgcggcttactaccccagggcgaacggacggacgacggaggcgggagccggtagccgagccgggcgacctagagaacgagcgggtcaggctcagcgtcggccactctgtcggtccgctgaatgaagtgcccgcccctctaagcccggagcccggcgctttccccgcaagatggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagaaggagaatatattaaaatgtttatgcgcggtcggccaattaccatgttcattccttccgatgttgacaactatgatgacatcagaacggaactgcctcctgagaagctcaaactggagtgggcatatggttatcgaggaaaggactgtagagctaatgtttaccttcttccgaccgggaaaatagtttatttcattgcatcagtagtagtactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtattattgatgactccaatgagcatatgcttactgtatgggactggcagaagaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagaggttcctgatcagtatggcacaatcagagctgtagcagaaggaaaggcagatcaatttttagtaggcacatcacgaaactttattttacgaggaacatttaatgatggcttccaaatagaagtacagggtcatacagatgagctttggggtcttgccacacatcccttcaaagatttgctcttgacatgtgctcaggacaggcaggtgtgcctgtggaactcaatggaacacaggctggaatggaccaggctggtagatgaaccaggacactgtgcagattttcatccaagtggcacagtggtggccataggaacgcactcaggcaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatatagcagatatggaaggtgcactggacattccagctacatcacacaccttgactggtccccagacaacaagtatataatgtctaactcgggagactatgaaatattgtactgggacattccaaatggctgcaaactaatcaggaatcgatcggattgtaaggacattgattggacgacatatacctgtgtgctaggatttcaagtatttggtgtctggccagaaggatctgatgggacagatatcaatgcactggtgcgatcccacaatagaaaggtgatagctgttgccgatgacttttgtaaagtccatctgtttcagtatccctgctccaaagcaaaggctcccagtcacaagtacagtgcccacagcagccatgtcaccaatgtcagttttactcacaatgacagtcacctgatatcaactggtggaaaagacatgagcatcattcagtggaaacttgtggaaaagttatctttgcctcagaatgagactgtagcggatactactctaaccaaagcccccgtctcttccactgaaagtgtcatccaatctaatactcccacaccgcctccttctcagcccttaaatgagacagctgaagaggaaagtagaataagcagttctcccacacttctggagaacagcctggaacaaactgtggagccaagtgaagaccacagcgaggaggagagtgaagagggcagcggagaccttggtgagcctctttatgaagagccatgcaacgagataagcaaggagcaggccaaagccacccttctggaggaccagcaagacccttcgccctcgtcctaacaccctggcttcagtgcaactcttttccttcagctgcatgtgattttgtgataaagttcaggtaacaggatgggcagtgatggagaatcactgttgattgagattttggtttccatgtgatttgttttcttcaatagtcttattttcagtctctcaaatacagccaacttaaagttttagtttggtgtttattgaaaattaaccaaacttaatactaggagaagactgaatcattaatgatgtctcacaaattactgtgtacctaagtggtgtgatgtaaatactggaaacaaaaacagcagttgcattgattttgaaaacaaacccccttgttatctgaacatgttttcttcaggaacaaccagaggtatcacaaacactgttactcatctactggctcagactgtactacttttttttttttttttcctgaaaaagaaaccagaaaaaaatgtactcttactgagataccctctcaccccaaatgtgtaatggaaaatttttaattaagaaaaacttcagttttgccaagtgcaa

SEQ ID NO: 9212 - DNA, 1860 bp, Homo sapiens
agagaagttggagctttttcgttgtttttttttttttccctcctgtgacatgtgctttagttgcagtggaaaggaaatgtgtcatctgtggtttggttttaaaagtggaaaactagctgcacatatccttttttactgcagatttactttaaggctcatattctccaagtctattctgctttaaaaagaagacaagaaaagaagtggtttatcaaaatcacgttataatcagattttgaccaagcattttgtaagtatacaaatgtcagccaatgacatataacaaccatttcttataaaaccttgatgttcaaaagcctgactagcagtggcatccatgttgcttaggagttggtttggaaacaaagactttcaggccctacctatactagctagattgccaagcatgcccacggacatggaacacacaggacattacctacatcttgcctttctgatgacaacagttttttctttgtctcctggaacaaaagcaaactatacccgtctgtgggctaacagtacttcttcctgggattcagttattcaaaacaagacaggcagaaaccaaaatgaaaacattaacacaaaccctataactcctgaagtagattataaaggtaattctacaaacatgcctgaaacatctcacatcgtagctttaacttctaaatctgaacaggagctttatataccttctgtcgtcagcaacagtccttcaacagtacagagcattgaaaacacaagcaaaagtcatggtgaaattttcaaaaaggatgtctgtgcggaaaacaacaacaacatggctatgctaatttgcttaattataattgcagtgctttttcttatctgtacctttctatttctatcaactgtggttttggcaaacaaagtctcttctctcagacgatcaaaacaagtaggcaagcgtcagcctagaagcaatggcgattttctggcaagcggtctatggcccgctgaatcagacacttggaaaagaacaaaacagctcacaggacccaacctagtgatgcaatctactggagtgctcacagctacaagggaaagaaaagatgaagaaggaactgaaaaacttactaacaaacagataggttagtgaagaaaaatgcaaagtagcaatgagaaggcttatggagtaaaaatgaagtcagttggtatttaatcccaaagtgttgttctgattatctaaaatttgacatggtagaccttgcaatttagaatcaagcaggtgagacagggagaagtatgcctgcttaattatttaaactgtgtacttttgttttgacactgaatattttaaaaagcaaataataaaataactaagcatttgaggaaaattttaaggataaattgaggaaactgattaatagagatagcaagggataattaaataaatattccctatgtagcaacagtggttagatgatctttgtctgaatgtaattaaactttgaatagttttagtgtgtccttaaagccaagtatatgctttaacatcaaatggaagtcaaattcctaatgcatagatagagagagctaaactgtgtaatttaatggtatcttccttgctggatgtggcagaatccacaccagcttatcaaccaacacagctaattttagaatagatcctttatctttccatatggcacacgtaagaaagtgtttttctactattaatattaaattaaaacctttacttttgtataataaattaaaactcagaataaacctgtgaccacgtatatttgcattcactttattactttagagaacacattgtaaagatcaataagaaatagagcacaactaaaataaataagatttatagccacaccaata

SEQ ID NO: 9213 - DNA, 2869 bp, Homo sapiens
agagaagttggagctttttcgttgtttttttttttttccctcctgtgacatgtgctttagttgcagtggaaaggaaatgtgtcatctgtggtttggttttaaaagtggaaaactagctgcacatatccttttttactgcagatttactttaaggctcatattctccaagtctattctgctttaaaaagaagacaagaaaagaagtggtttatcaaaatcacgttataatcagattttgaccaagcattttgtaagattgccaagcatgcccacggacatggaacacacaggacattacctacatcttgcctttctgatgacaacagttttttctttgtctcctggaacaaaagcaaactatacccgtctgtgggctaacagtacttcttcctgggattcagttattcaaaacaagacaggcagaaaccaaaatgaaaacattaacacaaaccctataactcctgaagtagattataaaggtaattctacaaacatgcctgaaacatctcacatcgtagctttaacttctaaatctgaacaggagctttatataccttctgtcgtcagcaacagtccttcaacagtacagagcattgaaaacacaagcaaaagtcatggtgaaattttcaaaaaggatgtctgtgcggaaaacaacaacaacatggctatgctaatttgcttaattataattgcagtgctttttcttatctgtacctttctatttctatcaactgtggttttggcaaacaaagtctcttctctcagacgatcaaaacaagtaggcaagcgtcagcctagaagcaatggcgattttctggcaagcggtctatggcccgctgaatcagacacttggaaaagaacaaaacagctcacaggacccaacctagtgatgcaatctactggagtgctcacagctacaagggaaagaaaagatgaagaaggaactgaaaaacttactaacaaacagataggttagtgaagaaaaatgcaaagtagcaatgagaaggcttatggagtaaaaatgaagtcagttggtatttaatcccaaagtgttgttctgattatctaaaatttgacatggtagaccttgcaatttagaatcaagcaggtgagacagggagaagtatgcctgcttaattatttaaactgtgtacttttgttttgacactgaatattttaaaaagcaaataataaaataactaagcatttgaggaaaattttaaggataaattgaggaaactgattaatagagatagcaagggataattaaataaatattccctatgtagcaacagtggttagatgatctttgtctgaatgtaattaaactttgaatagttttagtgtgtccttaaagccaagtatatgctttaacatcaaatggaagtcaaattcctaatgcatagatagagagagctaaactgtgtaatttaatggtatcttccttgctggatgtggcagaatccacaccagcttatcaaccaacacagctaattttagaatagatcctttatctttccatatggcacacgtaagaaagtgtttttctactattaatattaaattaaaacctttacttttgtataataaattaaaactcagaataaacctgtgaccacgtatatttgcattcactttattactttagagaacacattgtaaagatcaataagaaatagagcacaactaaaataaataagatttatagccacaccaataggctaagtgtaaacgcaaagtatgtttcactgtttatgattaataatattcatcttttctataaatactacttactggaacattaacaacaagtaccaaaggttgattaatttttggacttcaaggatgccaagtagcctaatgatttattaggggtgtgtgtgtgtgtgtgtgtgtgtgtgtgtgtgtgttcaaatctggaaaactgcatacttcaggttataatttaacctttaaagaaactggcttcaagtaaaataatgacttacatttaagttgagaacccccccatcttcaattaaatatattacaaaaattggtttgagagactttccaaatatctactgaaattaacacagggctaagatcaggccacatttcaaaaatctcatcccttactgggcatttatttcgggcaatatagtaaccattttaaaaatattttttatatgttttttcccaagtatgactacaatcttactctcccttctaagctagtgattcttaccctggctgcatgtcagaatcacctgaagagtttttaaaaaacaccaatgcctaattcccatgtcttccttctgatgcaactggaatggggtgaactctaagcattggtaatttttacgtaactctcaaggtgataactgctcttggtcatcaaattcaaacgtctagctattattaaaatgagaggaaaaaaataaagcatcatttttattatcaatttattagcaatttgtaaaaaacaaatctattctctaaacgagaaatcataacaatattattccagataaagttaagtgttaacaaagtaaaaaggaaagcatgagaatattcatgccagtcatggtgactgaaatcaggttatcttttgaggggaaaaataacccagattagaaatgaaactgggcagacttcccattctgtgcaaaaattgaaaatttgagattgtgcaccagtacatccaggagtaacacaaagcactccttgaatcaagggtcataaataaacacgtgtcagagaaaattaaaagaaattaatatcatcataaaaataggaaattactttcatattcaacatactggtcaaacattttctcaccagagagcttctaccacaaggatatttaaaagaatatttaaaattcacc

SEQ ID NO: 9214 - DNA, 1540 bp, Homo sapiens
atacagtttgtttatttgggcactgcagtacatctggctgaagacaatcaacagcaggcctattatctgttccgtgattgccaagcatgcccacggacatggaacacacaggacattacctacatcttgcctttctgatgacaacagttttttctttgtctcctggaacaaaagcaaactatacccgtctgtgggctaacagtacttcttcctgggattcagttattcaaaacaagacaggcagaaaccaaaatgaaaacattaacacaaaccctataactcctgaagtagattataaaggtaattctacaaacatgcctgaaacatctcacatcgtagctttaacttctaaatctgaacaggagctttatataccttctgtcgtcagcaacagtccttcaacagtacagagcattgaaaacacaagcaaaagtcatggtgaaattttcaaaaaggatgtctgtgcggaaaacaacaacaacatggctatgctaatttgcttaattataattgcagtgctttttcttatctgtacctttctatttctatcaactgtggttttggcaaacaaagtctcttctctcagacgatcaaaacaagtaggcaagcgtcagcctagaagcaatggcgattttctggcaagcggtctatggcccgctgaatcagacacttggaaaagaacaaaacagctcacaggacccaacctagtgatgcaatctactggagtgctcacagctacaagggaaagaaaagatgaagaaggaactgaaaaacttactaacaaacagataggttagtgaagaaaaatgcaaagtagcaatgagaaggcttatggagtaaaaatgaagtcagttggtatttaatcccaaagtgttgttctgattatctaaaatttgacatggtagaccttgcaatttagaatcaagcaggtgagacagggagaagtatgcctgcttaattatttaaactgtgtacttttgttttgacactgaatattttaaaaagcaaataataaaataactaagcatttgaggaaaattttaaggataaattgaggaaactgattaatagagatagcaagggataattaaataaatattccctatgtagcaacagtggttagatgatctttgtctgaatgtaattaaactttgaatagttttagtgtgtccttaaagccaagtatatgctttaacatcaaatggaagtcaaattcctaatgcatagatagagagagctaaactgtgtaatttaatggtatcttccttgctggatgtggcagaatccacaccagcttatcaaccaacacagctaattttagaatagatcctttatctttccatatggcacacgtaagaaagtgtttttctactattaatattaaattaaaacctttacttttgtataataaattaaaactcagaataaacctgtgaccacgtatatttgcattcactttattactttagagaacacattgtaaagatcaataagaaatagagcacaactaaaataaataagatttatagccacaccaata

SEQ ID NO: 9215 - DNA, 1719 bp, Homo sapiens
agagaagttggagctttttcgttgtttttttttttttccctcctgtgacatgtgctttagttgcagtggaaaggaaatgtgtcatctgtggtttggttttaaaagtggaaaactagctgcacatatccttttttactgcagatttactttaaggctcatattctccaagtctattctgctttaaaaagaagacaagaaaagaagtggtttatcaaaatcacgttataatcagattttgaccaagcattttgtaagattgccaagcatgcccacggacatggaacacacaggacattacctacatcttgcctttctgatgacaacagttttttctttgtctcctggaacaaaagcaaactatacccgtctgtgggctaacagtacttcttcctgggattcagttattcaaaacaagacaggcagaaaccaaaatgaaaacattaacacaaaccctataactcctgaagtagattataaaggtaattctacaaacatgcctgaaacatctcacatcgtagctttaacttctaaatctgaacaggagctttatataccttctgtcgtcagcaacagtccttcaacagtacagagcattgaaaacacaagcaaaagtcatggtgaaattttcaaaaaggatgtctgtgcggaaaacaacaacaacatggctatgctaatttgcttaattataattgcagtgctttttcttatctgtacctttctatttctatcaactgtggttttggcaaacaaagtctcttctctcagacgatcaaaacaagtaggcaagcgtcagcctagaagcaatggcgattttctggcaagcggtctatggcccgctgaatcagacacttggaaaagaacaaaacagctcacaggacccaacctagtgatgcaatctactggagtgctcacagctacaagggaaagaaaagatgaagaaggaactgaaaaacttactaacaaacagataggttagtgaagaaaaatgcaaagtagcaatgagaaggcttatggagtaaaaatgaagtcagttggtatttaatcccaaagtgttgttctgattatctaaaatttgacatggtagaccttgcaatttagaatcaagcaggtgagacagggagaagtatgcctgcttaattatttaaactgtgtacttttgttttgacactgaatattttaaaaagcaaataataaaataactaagcatttgaggaaaattttaaggataaattgaggaaactgattaatagagatagcaagggataattaaataaatattccctatgtagcaacagtggttagatgatctttgtctgaatgtaattaaactttgaatagttttagtgtgtccttaaagccaagtatatgctttaacatcaaatggaagtcaaattcctaatgcatagatagagagagctaaactgtgtaatttaatggtatcttccttgctggatgtggcagaatccacaccagcttatcaaccaacacagctaattttagaatagatcctttatctttccatatggcacacgtaagaaagtgtttttctactattaatattaaattaaaacctttacttttgtataataaattaaaactcagaataaacctgtgaccacgtatatttgcattcactttattactttagagaacacattgtaaagatcaataagaaatagagcacaactaaaataaataagatttatagccacaccaata

SEQ ID NO: 9216 - DNA, 1986 bp, Homo sapiens
atttcagtttgctagaggaacattttaaatctgaattgaaccacccattttcctttcttagccaaatcaccaaaatgtccagttagaacaagaatttagcattctgcaaaagaagttaacagctgagataacgaggaaatattctgaaatggatcccaaatatttcatcttaattttgttttgtggacacctgaacaatacatttttttcaaagacagagacaattacaacagagaagcagtcacagcctaccttattcacatcatcaatgtcacaggtattggctaattctcaaaacacaacagggaatcctttgggtcaaccaacacaattcagcgacactttttctggacaatcaatatcacctgccaaagtcactgctggacaaccaacaccagctgtctatacctcttctgaaaaaccagaagcacatacttctgctggacaaccacttgcctacaacaccaaacaaccaacaccaatagccaacacctcctcccagcaagccgtgttcacctctgccagacaactaccatctgcccgtacttctaccacacaaccaccaaagtcatttgtctatacttttactcaacaatcatcatctgtccagatcccttctagaaaacaaataactgttcataatccatccacacaaccaacatcaactgtcaaaaattcacctaggagtacaccaggatttatcttagatactaccagtaacaaacaaaccccacaaaaaaacaattataattcaatagctgccatactaattggtgtacttctgacttctatgttggtagctataatcatcattgtactttggaaatgcttaaggaaaccagttttaaatgatcaaaattgggcaggtagatctccatttgctgatggagaaacccctgacatttgtatggataacatcagagaaaatgaaatatccacaaaacgtacatcaatcatttcacttacaccctggaaaccaagcaaaagcacacttttagcagatgacttagaaattaagttgtttgaatcaagtgaaaacattgaagactccaacaaccccaaaacagagaaaataaaagatcaagtaaatggtacatcagaagatagtgctgatggttcaacagttggaactgctgtttcttcttcagatgatgcagatctgcctccaccacctccccttctggatttggaaggacaggaaagtaaccaatctgacaaacccacaatgacaattgtatctcctcttccaaatgattctactagtctccctccatctctggactgtctcaatcaagactgtggagatcataaatctgagataatacaatcatttccaccgcttgactcacttaacttgcccctgccaccagtagattttatgaaaaaccaagaagattccaaccttgagatccagtgtcaggagttctctattcctcccaactctgatcaagatcttaatgaatccctgccacctccacctgcagaactgttataaatattacaacttgctttttagctgatcttccatcctcaaatgactcttttttctttatatgttaacatatataaaatggcaactgatagtcaattttgatttttattcaggaactatctgaaatctgctcagagcctatgtgcatagatgaaacttttttttaaaaaaagttatttaacagtaatctatttactaattatagtacctatctttaaagtatagtacattttacatatgtaaatggtatgtttcaataatttaagaactctgaaacaatctacatatacttattacccagtacagttttttttcccctgaaaagctgtgtataaaattatggtgaataaacttttatgtttccatttcaaagaccagggtggagaggaataagagactaagtatatgcttcaagttttaaattaatacctcaagtattaaataaatattccaagtttgtgggaatgggagattaaaatgcatgtttgagaata

SEQ ID NO: 9217 - DNA, 1576 bp, Homo sapiens
attttaaatctgaattgaaccacccattttcctttcttagccaaatcaccaaaatgtccagttagaacaagaatttagcattctgcaaaagaagttaacagctgagggccatttatcatcactgtgtaccaagtggtagaggagtaagcaatgatatgctgtttagatatgctgaaaagataacgaggaaatattctgaaatggatcccaaatatttcatcttaattttgttttgtggacacctgaacaatacatttttttcaaagacagagacaattacaacagagaagcagtcacagcctaccttattcacatcatcaatgtcacaggtattggctaattctcaaaacacaacagggaatcctttgggtcaaccaacacaattcagcgacactttttctggacaatcaatatcacctgccaaagtcactgctggacaaccaacaccagctgtctatacctcttctgaaaaaccagaagcacatacttctgctggacaaccacttgcctacaacaccaaacaaccaacaccaatagccaacacctcctcccagcaagccgtgttcacctctgccagacaactaccatctgcccgtacttctaccacacaaccaccaaagtcatttgtctatacttttactcaacaatcatcatctgtccagatcccttctagaaaacaaataactgttcataatccatccacacaaccaacatcaactgtcaaaaattcacctaggagtacaccaggatttatcttagatactaccagtaacaaacaaaccccacaaaaaaacaattataattcaatagctgccatactaattggtgtacttctgacttctatgttggtagctataatcatcattgtactttggaaatgcttaaggaaaccagttttaaatgatcaaaattgggcaggtagatctccatttgctgatggagaaacccctgacatttgtatggataacatcagagaaaatgaaatatccacaaaacgtacatcaatcatttcacttacaccctggaaaccaagcaaaagcacacttttagcagatgacttagaaattaagttgtttgaatcaagtgaaaacattgaagactccaacaaccccaaaacagagaaaataaaagatcaagtaaatggtacatcagaagatagtgctgatggttcaacagttggaactgctgtttcttcttcagatgatgcagatctgcctccaccacctccccttctggatttggaaggacaggaaagtaaccaatctgacaaacccacaatgacaattgtatctcctcttccaaatgattctactagtctccctccatctctggactgtctcaatcaagactgtggagatcataaatctgagataatacaatcatttccaccgcttgactcacttaacttgcccctgccaccagtagattttatgaaaaaccaagaagattccaaccttgagatccagtgtcaggagttctctattcctcccaactctgatcaagatcttaatgaatccctgccacctccacctgcagaactgttataaatattacaacttgctttttagctgatctt

SEQ ID NO: 9218 - DNA, 2007 bp, Homo sapiens
atggttaccaacaaaatgactgctgcctttagaaaccctagtgggaaacaggtggcgacagacaaagttgcagaaaagctgagctctactctctcatgggtgaagaacacagtatcgcatacagtcagtcagatggccagtcaggtggcaagtccatctacttcattacataccacatcctcatctaccacactatcaacaccagccctttcaccatcttccccatcacagttgagtccagacgacttagaactcctggctaaactggaagaacagaatagattgttagaaacggatagtaagtctttaagatctgtaaatgggtcaagaagaaacagtggctcttctcttgtgtcgagttcatcagcctctagcaacctcagtcaccttgaagaagattcttggattctttggggaagaattgttaatgaatgggaagatgtacgcaaaaagaaggaaaagcaagttaaggaacttgttcataaagggataccccatcactttagagcaatagtttggcaacttttatgcagtgcacaaagtatgccaattaaggatcagtattcagaactcctgaaaatgacctcgccttgtgaaaaattgatccgaagggacattgctagaacttaccctgaacacaacttttttaaggaaaaagatagccttggacaggaggttttatttaatgtaatgaaggcttactctttagtagatcgtgaggttggttactgtcaaggaagtgcttttatagttggattgttgcttatgcagatgccagaagaagaagctttctgtgtatttgttaaattaatgcaagattatagacttcgtgaactttttaaaccaagtatggcagaattgggcctttgtatgtaccagtttgaatgtatgatacaggagcatcttccagagctctttgtacattttcaatctcagagttttcatacctcaatgtatgcatcatcctggtttctgactatctttcttacaacttttccactaccaattgcaacaaggatatttgatatctttatgtctgagggtttagaaatagtgtttcgtgtaggattagcacttcttcagatgaatcaggcagaactgatgcaacttgacatggaagggatgttacagcactttcaaaaggtcattccacatcagtttgatggtgtcccagacaagctaatccaagcagcttaccaagtcaaatacaattcaaaaaaaatgaaaaagcttgaaaaggaatacactacaataaaaacgaaagaaatggaagagcaagttgaaattaaaaggttacgcacagaaaatagacttttaaaacagcgcatcgagacattagaaaaagaaagtgcttccttggcagatagattgatacagggacaagtgacaagagcccaggaggctgaggaaaactacctcataaaacgggagttggccaccatcaaacagcagagtgatgaggccagtgctaagctggagcaagctgaaaataccatcaggaagctccagcaccaacaacaatggcataaatgcagttccaactacaacgaagattttgtgctacagctagagaaggaattggtccaagcccgactgagtgaagctgagtctcagtgtgcattaaaagagatgcaggataaagtcttggatatagagaagaggaataactcccttcctgatgagaataatattgcaaggcttcaggaagaactcattgctgtgaaacttagagaagcagaagccattatgggtttgaaagaacttagacagcaagtcaaggatttagaggaacactggcagcgccacttagctcgtactactgggagatggaaagacccacccaagaaaaatgctatgaatgagttacaagatgaactgatgaccattcgacttagagaagctgaaacacaagcagaaataagagaaataaaacaaaggatgatggaaatggaaacacagtctggaacctgtggaccccttcttaaaataatattttttaatgcgtaa

SEQ ID NO: 9219 - DNA, 7403 bp, Homo sapiens
tctgcttatcatggttaccaacaaaatgactgctgcctttagaaaccctagtgggaaacaggtggcgacagacaaagttgcagaaaagctgagctctactctctcatgggtgaagaacacagtatcgcatacagtcagtcagatggccagtcaggtggcaagtccatctacttcattacataccacatcctcatctaccacactatcaacaccagccctttcaccatcttccccatcacagttgagtccagacgacttagaactcctggctaaactggaagaacagaatagattgttagaaacggatagtaagtctttaagatctgtaaatgggtcaagaagaaacagtggctcttctcttgtgtcgagttcatcagcctctagcaacctcagtcaccttgaagaagattcttggattctttggggaagaattgttaatgaatgggaagatgtacgcaaaaagaaggaaaagcaagttaaggaacttgttcataaagggataccccatcactttagagcaatagtttggcaacttttatgcagtgcacaaagtatgccaattaaggatcagtattcagaactcctgaaaatgacctcgccttgtgaaaaattgatccgaagggacattgctagaacttaccctgaacacaacttttttaaggaaaaagatagccttggacaggaggttttatttaatgtaatgaaggcttactctttagtagatcgtgaggttggttactgtcaaggaagtgcttttatagttggattgttgcttatgcagatgccagaagaagaagctttctgtgtatttgttaaattaatgcaagattatagacttcgtgaactttttaaaccaagtatggcagaattgggcctttgtatgtaccagtttgaatgtatgatacaggagcatcttccagagctctttgtacattttcaatctcagagttttcatacctcaatgtatgcatcatcctggtttctgactatctttcttacaacttttccactaccaattgcaacaaggatatttgatatctttatgtctgagggtttagaaatagtgtttcgtgtaggattagcacttcttcagatgaatcaggcagaactgatgcaacttgacatggaagggatgttacagcactttcaaaaggtcattccacatcagtttgatggtgtcccagacaagctaatccaagcagcttaccaagtcaaatacaattcaaaaaaaatgaaaaagcttgaaaaggaatacactacaataaaaacgaaagaaatggaagagcaagttgaaattaaaaggttacgcacagaaaatagacttttaaaacagcgcatcgagacattagaaaaacataaatgcagttccaactacaacgaagattttgtgctacagctagagaaggaattggtccaagcccgactgagtgaagctgagtctcagtgtgcattaaaagagatgcaggataaagtcttggatatagagaagaggaataactcccttcctgatgagaataatattgcaaggcttcaggaagaactcattgctgtgaaacttagagaagcagaagccattatgggtttgaaagaacttagacagcaagtcaaggatttagaggaacactggcagcgccacttagctcgtactactgggagatggaaagacccacccaagaaaaatgctatgaatgagttacaagatgaactgatgaccattcgacttagagaagctgaaacacaagcagaaataagagaaataaaacaaaggatgatggaaatggaaacacagaaccagatcaatagtaaccatcttcgaagagcagaacaagaggtgattagcctacaggagaaagtgcagtatctttctgcacagaacaaaggactccttactcaattaagtgaagcaaagcgtaaacaagcagagattgaatgcaagaataaggaagaagtgatggctgtgaggcttcgggaagcagatagcatagctgctgtggctgaactacgacaacacattgctgagcttgaaatccagaaagaagaaggaaagcttcaaggacagcttaacaagtctgattctaaccagtatattggggaactgaaagatcagatagcagagctgaatcatgagctcaggtgcctaaaaggccagaggggcttctcaggccaacctccttttgatggaatccacattgtcaaccatttaataggagatgatgaatcattccattcctccgatgaagattttatagataattccttacaggaaactggtgttggttttcctttgcacggaaaatctggttcgatgtctttggaccccgcagtggcagatggtagtgagagcgaaacagaagacagtgtgctggagaccagagagagcaaccaagtggttcaaaaggagcggcccccgagaagaagagagtcgtattcaaccactgtctgaccatcactgtgacctagactatggatttatttaagggatcagttatcatatgattagggctttttggaaataatttgtttcatatgtacatatatatatatatatatatatatatatatatatatatatatatatatatatatattttacagtcttatctgcctttttatctttgccaaatctttaccactgatttaccattgccataaagtagactggtatatggttaatgtgtaaaacaaggttctaacagtattactgaatattaatgtttcttgtttagaaaatgcaactatatctatatgtgggaaccattctgaagttcaaaactatggaaaattgaattttcttcagacaaaactgctcttgtgcaatattttatgctcagtgagcaaattgtgtatttatgtttatcaatttgttctcaaggtggctgtctacagacatttgaccaagacatacatctgatttaccttgtgtttttttttttattgttgtttttttttttaagacagagattcagtctgtcacccaggctggagtgctgtggtgtgatcttagctcactgcaacctccgcctcccaggttcaagcaattttcctgcctcagcctcccgagtacctgggactatatgtgcgcaccaccacgcctggctaattttttgtatttttagtagagatggggtttcaccatgttggctgggctggtctcgaactcctaacctcaagtgatccacccgcctcagcctcccaaagtgctgggattacaggtgtgagccactgcacccagcctaccttgtctgtttgtgtctgggaggttttttttttctatttttattttttcatgaaaattattggtgggccactgaaagtccccacacacaaagcctttattctatataattttataaacacaaattcatgattatctgttttgagagttttaagttttgttttaatgtttaacttttatgtgcatatgatgcttccatgtgttggttactagagtagtaggttaactacagacatactgttttgtttgtacatatttataaatctgtaccacctaacattgaacatcattttatatgaagaacatacatgttgcaaaatgactgctttcagcatctaacaggacttctgtaaataataggttaaaagttaaaaataaaacactaatgttttaagagctttagtattttgcttagcattcaatactagcagattcataactgatgcctgttcaaaaacactgttggtggaatcttttatttcatgtgtatgtaactactaaatttttcatgactgaagaggttatagcacatattagttagtgctaatattctactgaatataatttaagcaatgggctaaggtccaagaaacatagcaattatatctacaaataatctattaacatgatcttcagaatctctagtttttgttctatagataaagccataagaatcctttcctaccagtttttcctatatcatttagatattatttcctagaaaacaggatgcctgtcactgataagttagagaaaacacccaaattatacttgcactatggaaagacgacatgaatatgttgactgggtactttctactctcatttttgttagcctatgaaaaaaaaaacattttgttaacctatggaaaaagccttggaagagaaaagtagaattcagtatgtatggaggcacagttttgcacagtatgttgcatgcggcaaaaaaaaaaatatgaaatagagtagaagagataaaagtagttttctgtcaaaaactaggagttaagccttcaggtacgttgtggactaggctttccagcaaggtttttgtagctatttgcttgcctgagaaatgaaattgaaaacatacccctgcgtgtctgtccttaacaccaggctaaattctggtggttaaataacttatctgtggttacaagctagtaagtagcagagccaagattttttttaatatagagacaggtgtctcactgtgttgtccaggctggtcttgaactcctggcctcaagtggtcctcctgcctcagcctcccaaagtgtggggattacaggtgcgagctactgctcccagcaagagccaagattttaacctagatctccctaacaccaaagcttttgaaagggttcagctgaagaatttctcaattctctgttttgttttgtttttatttttgttttttgagatgaagtctcactgcactcaggctggagtgcagtggtacgatcttggctcactgcaacctccacctcccgggttcaagcgattctcctgcctcagctcccaagtagctgggactacaggtgcacgccaccacaactggctaatttttgtatttttagtagagatggggtttcgctatgttggccaggctgatctcaaacttctgacctcaggtgatccacccactttgacctcccaaagtgctgggattactagacgtaagccaccacacctggcaattccctgcttttttgacaacataatttaaatgaatttgatttaaatgtttcctgaatatatatacagatagatagatgagtatcaacacttacaagctctacacagtctgtgagtgtagatactacttactcgtaggattgtcttgtgctttggggatttttgttcggagttctatactatcagcccagaaagctatcaatgtccaagtgaagtgagatgatgcatggccacattattgctttgaccctcacatcaagaaatctgaatgatctggaccaggggtcagcaaagtgcagcctacaagctattgcagtcagctgccagtttttacttttttaaatagttgggaaaaaaattccaaagactgatattttgtgtcacatgaaaattatatgaaattcaaattgcagtgtccataagtaaagttttattggggcacacccatgctcacccttttaaatattgtgtatggccgctttgtgctacagtagcagagttgagtcattgcaagggagaccatatggcccaggtagcctaaaatatttatctgatcctttacagaaaaagtttgctaacccttgataacagatactctaaaatgcaggtttttcttcttcaatttagctcagtggtaggtcaaattgtttgcttttgctattaagcttatgatttggaaacgtaaaatttcatggtggatattataatcagaactattcaaaagggaaaacatgccagccattttatatgatgaagtctcttattccatagaaaactgtagaaagatatctgtatctttggagaaggagaaagaaaggaaagaactccagaatcccatcactgttctttaaagcatgcatcacagacctttaagagtatgctttattgagtaaaggttatagtttgactttaagataagaaattttctagaatcatgtttgaattctaaacgttgatattcttaagtaccatttctgattaggaattaggtgttaaaagaatcatggtaaggaaaccttaatccgttgaaactcttgtaatttggacaacaaaaaactagaaataacactcttttctttgaagatctgattcaaatacaccttagaagagtttaaaatctcccaggcctttaggatgcaataggatattatgccttggtttgactccttttcattcaaattaatgtaagtatgttgttcaagactttgaagcattgaacaatgttctcgatgaattttatttaattactgacattttgtgatatttgaatgttattaagttaaacacttagagttgagtatattcaggggagaaaagtgaatgaaatgactcataataagaaagcttgctcccttgggacagttaccttcctggtgtcattgccatcctgggttgacaagctgagagtagaggatacaagtgatgtgaataaaatggaaattgcattgagttaatgaaacagacacttttagatcaagaaaacacttcaacagcctttttagaaattggcacactcctatagtcccacctactcaagaggctgaggcaggaggatcactagagtacaggagtttggggctgtagtgtgtaatgatcacacctgtgaaagaataaccactgcactccaacctgggcaacatggcaagaccctgtctctttaaaaaaaaaaaaaatcctgggaaaagaagtcaaagatgtaattttacacaatttctgcccccaccgtcttttttgtttgtttgtttgtttgtttgttttttggctagatactaggtattcagtgtttgctgagatgacaggtttctactaatcagccagttatttgggaaggagaaaaactttttctcaattctgaacatgatgcagcttgttaactctccagatagtgcctttgattgaaaataaggtctacacctttttaagtatattatttctgacatcgtaagaaataatttagttccttattctcatttatcttttatataatgtactgtaatattcaggtttaaagtaaaataagtatatgaattatattttggtaaaactgtttcatgaccagcttgattaatgtatattaacataccagacattgacagcgaacatttcatgaaatcagttatttacttaccaaaacaatgagttttagcttgaaagttactgctgctctattattaacaaaactaagttttaaaaattaattttaattctactgaagtttaatttctggttaaaggtatagtggatgctatttatgatccaagtttttacatcacatccattgatctgcctatcccttctttttactccaaagaggagatgatagaataatacattcagtatactaccaagaagcaaagttataatgtgtttcattttgctattggaattttttattgtaacattgtatgataacctgaaatgtttacttgtgccttttctttaaacaattaaagttttccattttataagaa

SEQ ID NO: 9220 - DNA, 7362 bp, Homo sapiens
tctgcttatcatggttaccaacaaaatgactgctgcctttagaaaccctagtgggaaacaggtggcgacagacaaagttgcagaaaagctgagctctactctctcatgggtgaagaacacagtatcgcatacagtcagtcagatggccagtcaggtggcaagtccatctacttcattacataccacatcctcatctaccacactatcaacaccagccctttcaccatcttccccatcacagttgagtccagacgacttagaactcctggctaaactggaagaacagaatagattgttagaaacggatagtaagtctttaagatctgtaaatgggtcaagaagaaacagtggctcttctcttgtgtcgagttcatcagcctctagcaacctcagtcaccttgaagaagattcttggattctttggggaagaattgttaatgaatgggaagatgtacgcaaaaagaaggaaaagcaagttaaggaacttgttcataaagggataccccatcactttagagcaatagtttggcaacttttatgcagtgcacaaagtatgccaattaaggatcagtattcagaactcctgaaaatgacctcgccttgtgaaaaattgatccgaagggacattgctagaacttaccctgaacacaacttttttaaggaaaaagatagccttggacaggaggttttatttaatgtaatgaaggcttactctttagtagatcgtgaggttggttactgtcaaggaagtgcttttatagttggattgttgcttatgcagatgccagaagaagaagctttctgtgtatttgttaaattaatgcaagattatagacttcgtgaactttttaaaccaagtatggcagaattgggcctttgtatgtaccagtttgaatgtatgatacaggagcatcttccagagctctttgtacattttcaatctcagagttttcatacctcaatgtatgcatcatcctggtttctgactatctttcttacaacttttccactaccaattgcaacaaggatatttgatatctttatgtctgagggtttagaaatagtgtttcgtgtaggattagcacttcttcagatgaatcaggcagaactgatgcaacttgacatggaagggatgttacagcactttcaaaaggtcattccacatcagtttgatggtgtcccagacaagctaatccaagcagcttaccaagtcaaatacaattcaaaaaaaatgaaaaagcttgaaaaggaatacactacaataaaaacgaaagaaatggaagagcaagttgaaattaaaaggttacgcacagaaaatagacttttaaaacagcgcatcgagacattagaaaaacataaatgcagttccaactacaacgaagattttgtgctacagctagagaaggaattggtccaagcccgactgagtgaagctgagtctcagtgtgcattaaaagagatgcaggataaagtcttggatatagagaagaggaataactcccttcctgatgagaataatattgcaaggcttcaggaagaactcattgctgtgaaacttagagaagcagaagccattatgggtttgaaagaacttagacagcaagtcaaggatttagaggaacactggcagcgccacttagctcgtactactgggagatggaaagacccacccaagaaaaatgctatgaatgagttacaagatgaactgatgaccattcgacttagagaagctgaaacacaagcagaaataagagaaataaaacaaaggatgatggaaatggaaacacagaaccagatcaatagtaaccatcttcgaagagcagaacaagaggtgattagcctacaggagaaagtgcagtatctttctgcacagaacaaaggactccttactcaattaagtgaagcaaagcgtaaacaagcagagattgaatgcaagaataaggaagaagtgatggctgtgaggcttcgggaagcagatagcatagctgctgtggctgaactacgacaacacattgctgagcttgaaatccagaaagaagaaggaaagcttcaaggacagcttaacaagtctgattctaaccagtatattggggaactgaaagatcagatagcagagctgaatcatgagctcaggtgcctaaaaggccagaggggcttctcaggccaacctccttttgatggaatccacattgtcaaccatttaataggagatgatgaatcattccattcctccgatgaagattttatagataattccttacaggaaactggtgttggttttcctttgcacggaaaatctggttcgatgtctttggaccccgcagtggcagatggtagtgagagcgaaacagaagacagtgtgctggagaccagagagagcaaccaagtggttcaaaaggagcggcccccgagaagaagagagtcgtattcaaccactgtctgaccatcactgtgacctagactatggatttatttaagggatcagttatcatatgattagggctttttggaaataatttgtttcatatatatatatatatatatatatatatattttacagtcttatctgcctttttatctttgccaaatctttaccactgatttaccattgccataaagtagactggtatatggttaatgtgtaaaacaaggttctaacagtattactgaatattaatgtttcttgtttagaaaatgcaactatatctatatgtgggaaccattctgaagttcaaaactatggaaaattgaattttcttcagacaaaactgctcttgtgcaatattttatgctcagtgagcaaattgtgtatttatgtttatcaatttgttctcaaggtggctgtctacagacatttgaccaagacatacatctgatttaccttgtgtttttttttttattgttgtttttttttttaagacagagattcagtctgtcacccaggctggagtgctgtggtgtgatcttagctcactgcaacctccgcctcccaggttcaagcaattttcctgcctcagcctcccgagtacctgggactatatgtgcgcaccaccacgcctggctaattttttgtatttttagtagagatggggtttcaccatgttggctgggctggtctcgaactcctaacctcaagtgatccacccgcctcagcctcccaaagtgctgggattacaggtgtgagccactgcacccagcctaccttgtctgtttgtgtctgggaggttttttttttctatttttattttttcatgaaaattattggtgggccactgaaagtccccacacacaaagcctttattctatataattttataaacacaaattcatgattatctgttttgagagttttaagttttgttttaatgtttaacttttatgtgcatatgatgcttccatgtgttggttactagagtagtaggttaactacagacatactgttttgtttgtacatatttataaatctgtaccacctaacattgaacatcattttatatgaagaacatacatgttgcaaaatgactgctttcagcatctaacaggacttctgtaaataataggttaaaagttaaaaataaaacactaatgttttaagagctttagtattttgcttagcattcaatactagcagattcataactgatgcctgttcaaaaacactgttggtggaatcttttatttcatgtgtatgtaactactaaatttttcatgactgaagaggttatagcacatattagttagtgctaatattctactgaatataatttaagcaatgggctaaggtccaagaaacatagcaattatatctacaaataatctattaacatgatcttcagaatctctagtttttgttctatagataaagccataagaatcctttcctaccagtttttcctatatcatttagatattatttcctagaaaacaggatgcctgtcactgataagttagagaaaacacccaaattatacttgcactatggaaagacgacatgaatatgttgactgggtactttctactctcatttttgttagcctatgaaaaaaaaaacattttgttaacctatggaaaaagccttggaagagaaaagtagaattcagtatgtatggaggcacagttttgcacagtatgttgcatgcggcaaaaaaaaaaatatgaaatagagtagaagagataaaagtagttttctgtcaaaaactaggagttaagccttcaggtacgttgtggactaggctttccagcaaggtttttgtagctatttgcttgcctgagaaatgaaattgaaaacatacccctgcgtgtctgtccttaacaccaggctaaattctggtggttaaataacttatctgtggttacaagctagtaagtagcagagccaagattttttttaatatagagacaggtgtctcactgtgttgtccaggctggtcttgaactcctggcctcaagtggtcctcctgcctcagcctcccaaagtgtggggattacaggtgcgagctactgctcccagcaagagccaagattttaacctagatctccctaacaccaaagcttttgaaagggttcagctgaagaatttctcaattctctgttttgttttgtttttatttttgttttttgagatgaagtctcactgcactcaggctggagtgcagtggtacgatcttggctcactgcaacctccacctcccgggttcaagcgattctcctgcctcagctcccaagtagctgggactacaggtgcacgccaccacaactggctaatttttgtatttttagtagagatggggtttcgctatgttggccaggctgatctcaaacttctgacctcaggtgatccacccactttgacctcccaaagtgctgggattactagacgtaagccaccacacctggcaattccctgcttttttgacaacataatttaaatgaatttgatttaaatgtttcctgaatatatatacagatagatagatgagtatcaacacttacaagctctacacagtctgtgagtgtagatactacttactcgtaggattgtcttgtgctttggggatttttgttcggagttctatactatcagcccagaaagctatcaatgtccaagtgaagtgagatgatgcatggccacattattgctttgaccctcacatcaagaaatctgaatgatctggaccaggggtcagcaaagtgcagcctacaagctattgcagtcagctgccagtttttacttttttaaatagttgggaaaaaaattccaaagactgatattttgtgtcacatgaaaattatatgaaattcaaattgcagtgtccataagtaaagttttattggggcacacccatgctcacccttttaaatattgtgtatggccgctttgtgctacagtagcagagttgagtcattgcaagggagaccatatggcccaggtagcctaaaatatttatctgatcctttacagaaaaagtttgctaacccttgataacagatactctaaaatgcaggtttttcttcttcaatttagctcagtggtaggtcaaattgtttgcttttgctattaagcttatgatttggaaacgtaaaatttcatggtggatattataatcagaactattcaaaagggaaaacatgccagccattttatatgatgaagtctcttattccatagaaaactgtagaaagatatctgtatctttggagaaggagaaagaaaggaaagaactccagaatcccatcactgttctttaaagcatgcatcacagacctttaagagtatgctttattgagtaaaggttatagtttgactttaagataagaaattttctagaatcatgtttgaattctaaacgttgatattcttaagtaccatttctgattaggaattaggtgttaaaagaatcatggtaaggaaaccttaatccgttgaaactcttgtaatttggacaacaaaaaactagaaataacactcttttctttgaagatctgattcaaatacaccttagaagagtttaaaatctcccaggcctttaggatgcaataggatattatgccttggtttgactccttttcattcaaattaatgtaagtatgttgttcaagactttgaagcattgaacaatgttctcgatgaattttatttaattactgacattttgtgatatttgaatgttattaagttaaacacttagagttgagtatattcaggggagaaaagtgaatgaaatgactcataataagaaagcttgctcccttgggacagttaccttcctggtgtcattgccatcctgggttgacaagctgagagtagaggatacaagtgatgtgaataaaatggaaattgcattgagttaatgaaacagacacttttagatcaagaaaacacttcaacagcctttttagaaattggcacactcctatagtcccacctactcaagaggctgaggcaggaggatcactagagtacaggagtttggggctgtagtgtgtaatgatcacacctgtgaaagaataaccactgcactccaacctgggcaacatggcaagaccctgtctctttaaaaaaaaaaaaaatcctgggaaaagaagtcaaagatgtaattttacacaatttctgcccccaccgtcttttttgtttgtttgtttgtttgtttgttttttggctagatactaggtattcagtgtttgctgagatgacaggtttctactaatcagccagttatttgggaaggagaaaaactttttctcaattctgaacatgatgcagcttgttaactctccagatagtgcctttgattgaaaataaggtctacacctttttaagtatattatttctgacatcgtaagaaataatttagttccttattctcatttatcttttatataatgtactgtaatattcaggtttaaagtaaaataagtatatgaattatattttggtaaaactgtttcatgaccagcttgattaatgtatattaacataccagacattgacagcgaacatttcatgaaatcagttatttacttaccaaaacaatgagttttagcttgaaagttactgctgctctattattaacaaaactaagttttaaaaattaattttaattctactgaagtttaatttctggttaaaggtatagtggatgctatttatgatccaagtttttacatcacatccattgatctgcctatcccttctttttactccaaagaggagatgatagaataatacattcagtatactaccaagaagcaaagttataatgtgtttcattttgctattggaattttttattgtaacattgtatgataacctgaaatgtttacttgtgccttttctttaaacaattaaagttttccatttt

SEQ ID NO: 9221 - DNA, 2466 bp, Homo sapiens
atggttaccaacaaaatgactgctgcctttagaaaccctagtgggaaacaggtggcgacagacaaagttgcagaaaagctgagctctactctctcatgggtgaagaacacagtatcgcatacagtcagtcagatggccagtcaggtggcaagtccatctacttcattacataccacatcctcatctaccacactatcaacaccagccctttcaccatcttccccatcacagttgagtccagacgacttagaactcctggctaaactggaagaacagaatagattgttagaaacggatagtaagtctttaagatctgtaaatgggtcaagaagaaacagtggctcttctcttgtgtcgagttcatcagcctctagcaacctcagtcaccttgaagaagattcttggattctttggggaagaattgttaatgaatgggaagatgtacgcaaaaagaaggaaaagcaagttaaggaacttgttcataaagggataccccatcactttagagcaatagtttggcaacttttatgcagtgcacaaagtatgccaattaaggatcagtattcagaactcctgaaaatgacctcgccttgtgaaaaattgatccgaagggacattgctagaacttaccctgaacacaacttttttaaggaaaaagatagccttggacaggaggttttatttaatgtaatgaaggcttactctttagtagatcgtgaggttggttactgtcaaggaagtgcttttatagttggattgttgcttatgcagatgccagaagaagaagctttctgtgtatttgttaaattaatgcaagattatagacttcgtgaactttttaaaccaagtatggcagaattgggcctttgtatgtaccagtttgaatgtatgatacaggagcatcttccagagctctttgtacattttcaatctcagagttttcatacctcaatgtatgcatcatcctggtttctgactatctttcttacaacttttccactaccaattgcaacaaggatatttgatatctttatgtctgagggtttagaaatagtgtttcgtgtaggattagcacttcttcagatgaatcaggcagaactgatgcaacttgacatggaagggatgttacagcactttcaaaaggtcattccacatcagtttgatggtgtcccagacaagctaatccaagcagcttaccaagtcaaatacaattcaaaaaaaatgaaaaagcttgaaaaggaatacactacaataaaaacgaaagaaatggaagagcaagttgaaattaaaaggttacgcacagaaaatagacttttaaaacagcgcatcgagacattagaaaaagaaagtgcttccttggcagatagattgatacagcataaatgcagttccaactacaacgaagattttgtgctacagctagagaaggaattggtccaagcccgactgagtgaagctgagtctcagtgtgcattaaaagagatgcaggataaagtcttggatatagagaagaggaataactcccttcctgatgagaataatattgcaaggcttcaggaagaactcattgctgtgaaacttagagaagcagaagccattatgggtttgaaagaacttagacagcaagtcaaggatttagaggaacactggcagcgccacttagctcgtactactgggagatggaaagacccacccaagaaaaatgctatgaatgagttacaagatgaactgatgaccattcgacttagagaagctgaaacacaagcagaaataagagaaataaaacaaaggatgatggaaatggaaacacagaaccagatcaatagtaaccatcttcgaagagcagaacaagaggtgattagcctacaggagaaagtgcagtatctttctgcacagaacaaaggactccttactcaattaagtgaagcaaagcgtaaacaagcagagattgaatgcaagaataaggaagaagtgatggctgtgaggcttcgggaagcagatagcatagctgctgtggctgaactacgacaacacattgctgagcttgaaatccagaaagaagaaggaaagcttcaaggacagcttaacaagtctgattctaaccagtatattggggaactgaaagatcagatagcagagctgaatcatgagctcaggtgcctaaaaggccagaggggcttctcaggccaacctccttttgatggaatccacattgtcaaccatttaataggagatgatgaatcattccattcctccgatgaagattttatagataattccttacaggaaactggtgttggttttcctttgcacggaaaatctggttcgatgtctttggaccccgcagtggcagatggtagtgagagcgaaacagaagacagtgtgctggagaccagagagagcaaccaagtggttcaaaaggagcggcccccgagaagaagagagtcgtattcaaccactgtctga

SEQ ID NO: 9222 - DNA, 1535 bp, Homo sapiens
gatttgctacctccctggagctccctgacccggacgctctctgggccaatatggcagcgcccagcaacaagacagagctggcctggagtccgcggctggccgcgtgagtaggtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgc

SEQ ID NO: 9223 - DNA, 1684 bp, Homo sapiens
gatttgctacctccctggagctccctgacccggacgctctctgggccaatatggcagcgcccagcaacaagacagagctggcctggagtccgcggctggccgcgtgagtaggtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgc

SEQ ID NO: 9224 - DNA, 1042 bp, Homo sapiens
gatttgctacctccctggagctccctgacccggacgctctctgggccaatatggcagcgcccagcaacaagacagagctggcctggagtccgcggctggccgcgtgagtaggtgattgtctgacaagcagaggcatgagctgggtccaggccaccctactggcccgaggcctctgtagggcctggggaggcacctgcggggccgccctcacaggaacctccatctctcaggttcctttgcccaaagactcaacaggtgcagcagatcccccccagccccacatcgtaggaatccagagtcccgatcagcaggccgccctggcccgccacaatccagcccggcctgtctttgttgagggccccttctccctgtggctccgcaacaagtgtgtgtattaccacatcctcagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctagtctgagccggcgcgagggcacgggctgtggcccgaggaggcggtggactgaaggcatgagatgccctttgagtgtacagcaaatcaatgttttcctgcttggggctctcttccctcatctctagcagtatggcatcccctccccaggatctcgggctgccagcgatgggcaggcgagacccctccagaatctgcaggcgcctctggttctccgaattcaaataaaaaggggcgggagcgctgttggttgtgcgc

SEQ ID NO: 9225 - DNA, 1319 bp, Homo sapiens
ttttgcagatgacctcgcgagaggtcacgccgcaagtcggcaaccgggcaggatttggaatccgcgtctgcctttttcccccaagagacccagaatcctggcagccggtttcaaagctgttgtgattgtctgacaagcagaggcatgagctgggtccaggccaccctactggcccgaggcctctgtagggcctggggaggcacctgcggggccgccctcacaggaacctccatctctcaggtccctcgccggctccctcggggcctccactgcagcgcagctgcccatagctctgaacagtccctggttcccagcccaccggaaccccggcagaggcccaccaaggctctggtgccctttgaggacctgtttgggcaggcgcctggtggggaacgggacaaggcgagcttcctgcagacggtgcagaaatttgcggagcacagcgtgcgtaagcggggccacattgacttcatctacctggccctgcgcaagatgcgggagtatggtgtcgagcgggacctggctgtgtacaaccagctgctcaacatcttccccaaggaggtcttccggcctcgcaacatcatccagcgcatcttcgtccactaccctcggcagcaggagtgtgggattgctgtcctggagcagatggagaaccacggtgtgatgcccaacaaggagacggagttcctgctgattcagatctttggacgcaaaagctaccccatgctcaagttggtgcgcctgaagctgtggttccctcgattcatgaacgtcaaccccttcccagtgccccgggacctgccccaggaccctgtggagctggccatgtttggcctgcggcacatggagcctgaccttagtgccagggtcaccatctaccaggttcctttgcccaaagactcaacaggtgcagcagatcccccccagccccacatcgtagagctgacttgctgcccccggaggagagggaagtggaagagacgccggaggagtggaacctctactacccgatgcagctggacctggagtatgtgaggagtggctgggacaactacgagtttgacatcaatgaagtggaggaaggccctgtcttcgccatgtgcatggcgggtgctcatgaccaggcgacgatggctaagtggatccagggcctgcaggagaccaacccaaccctggcccagatccccgtggtcttccgcctcgccgggtccacccgggagctccagacatcctctgcagggctggaggagccgcccctgcccgaggaccaccaggaagaagacgacaacctgcagcgacagcagcagggccagagctag

SEQ ID NO: 9226 - DNA, 5517 bp, Homo sapiens
agagtccagccgggggtgccgcacccactggggagtggggagggaggacacataggaaatgcctggggctggagtctctttggctctctgccagcaagaaacttaaacgtcctggcttgctcaacccgagtgtccctaaactgtccagacttttgcccgtccattgccactatctctccccactctgggtgtcctacccaaggcgctgtctatgcgtgcccagggcctgtcctgcggatacccagctcgccccttgcagccctttttagagcatctcgcgggctctggcatcaccaagcgcacagccccgggctgcgctcccctaaggtgggtccctcagatccggggctgtccattaaccaggctggcccaaagaggcgcagacactcgaacccgggaaaacttattttattctcggttcccggggttgcagctgccagcggctgagacagtgcgtccgctttgtctctctgcactccccgcagcccccctctcccgcttcctctcccgattaactcccccgacacgctcttctctagctcctctcctcctcccactccttctcctcctcttcctcctcctacaccacaggccgcgctaatgcgcttcctccctcccccggtgtcggtctctttgcatacgcgccccctcccctccccgccgcgccacttatagcggggcgcacggcggcggggcgcagactgctctggcagccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgagtggaaacaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcaaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcagataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttca

SEQ ID NO: 9227 - DNA, 1405 bp, Homo sapiens
agagtccagccgggggtgccgcacccactggggagtggggagggaggacacataggaaatgcctggggctggagtctctttggctctctgccagcaagaaacttaaacgtcctggcttgctcaacccgagtgtccctaaactgtccagacttttgcccgtccattgccactatctctccccactctgggtgtcctacccaaggcgctgtctatgcgtgcccagggcctgtcctgcggatacccagctcgccccttgcagccctttttagagcatctcgcgggctctggcatcaccaagcgcacagccccgggctgcgctcccctaaggtgggtccctcagatccggggctgtccattaaccaggctggcccaaagaggcgcagacactcgaacccgggaaaacttattttattctcggttcccggggttgcagctgccagcggctgagacagtgcgtccgctttgtctctctgcactccccgcagcccccctctcccgcttcctctcccgattaactcccccgacacgctcttctctagctcctctcctcctcccactccttctcctcctcttcctcctcctacaccacaggccgcgctaatgcgcttcctccctcccccggtgtcggtctctttgcatacgcgccccctcccctccccgccgcgccacttatagcggggcgcacggcggcggggcgcagactgctctggcagccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctctggttttccaagaattgatataaagcgggaagaacagaaaacagcagtcataagtatgctactcaaaatattcttctttttatgtgccaaatcctcacattggaagctgtcccgagcaagacaggagtggaaacaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttct

SEQ ID NO: 9228 - DNA, 1280 bp, Homo sapiens
agagtccagccgggggtgccgcacccactggggagtggggagggaggacacataggaaatgcctggggctggagtctctttggctctctgccagcaagaaacttaaacgtcctggcttgctcaacccgagtgtccctaaactgtccagacttttgcccgtccattgccactatctctccccactctgggtgtcctacccaaggcgctgtctatgcgtgcccagggcctgtcctgcggatacccagctcgccccttgcagccctttttagagcatctcgcgggctctggcatcaccaagcgcacagccccgggctgcgctcccctaaggtgggtccctcagatccggggctgtccattaaccaggctggcccaaagaggcgcagacactcgaacccgggaaaacttattttattctcggttcccggggttgcagctgccagcggctgagacagtgcgtccgctttgtctctctgcactccccgcagcccccctctcccgcttcctctcccgattaactcccccgacacgctcttctctagctcctctcctcctcccactccttctcctcctcttcctcctcctacaccacaggccgcgctaatgcgcttcctccctcccccggtgtcggtctctttgcatacgcgccccctcccctccccgccgcgccacttatagcggggcgcacggcggcggggcgcagactgctctggcagccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgtgtcagcatttgcaggtatacaggaacagtcctagtgatgcactatttaatcaaaagacggatggatcttttgttcttgcagctggttttccaagaattgatataaagcgggaagaacagaaaacagcagtcataagagtggaaacaaaatgtcagtcagt

SEQ ID NO: 9229 - DNA, 2024 bp, Homo sapiens
cggcacacaaggcgctttctagctggccctcctttctccggggcattcgccaccgcttccctgggctgagacgaccggttcgtcgcctccttgcccgtgaccgtcgctagaactcagttgtgcgttgcggccagtcgccactgctgagtggaaacaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcaaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaag

SEQ ID NO: 9230 - DNA, 5381 bp, Homo sapiens
agagtccagccgggggtgccgcacccactggggagtggggagggaggacacataggaaatgcctggggctggagtctctttggctctctgccagcaagaaacttaaacgtcctggcttgctcaacccgagtgtccctaaactgtccagacttttgcccgtccattgccactatctctccccactctgggtgtcctacccaaggcgctgtctatgcgtgcccagggcctgtcctgcggatacccagctcgccccttgcagccctttttagagcatctcgcgggctctggcatcaccaagcgcacagccccgggctgcgctcccctaaggtgggtccctcagatccggggctgtccattaaccaggctggcccaaagaggcgcagacactcgaacccgggaaaacttattttattctcggttcccggggttgcagctgccagcggctgagacagtgcgtccgctttgtctctctgcactccccgcagcccccctctcccgcttcctctcccgattaactcccccgacacgctcttctctagctcctctcctcctcccactccttctcctcctcttcctcctcctacaccacaggccgcgctaatgcgcttcctccctcccccggtgtcggtctctttgcatacgcgccccctcccctccccgccgcgccacttatagcggggcgcacggcggcggggcgcagactgctctggcagccggagaggaggcggtgcggcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcaaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaggtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggttggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcagtatcacagatgtaaattaactcaccagatttactgggcctgaactcattctcttcttgctatatgatttagcaagttctagaaggtctccaagacaataattacattggcacaatgtatacttcagtgctcacccgtaggcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcagataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacacataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttca

SEQ ID NO: 9231 - DNA, 2982 bp, Homo sapiens
gcagatccccgctctcccgggcgccgctactcacacaggcttccagccgccacggggcgtcctctgtctgctgcagcggcggcggcagcagagggaacggcgactgcagcccggccgcgtctcccagctccgtgcccgggacagagtccgggagaagcaaaggaggaggaggacgccgaggctaggaggagccgcgccgcgcccggcgccccactccgcgcagcgggttgcctccgctccccatacggcggccccaggtcctttgctgccagcatgatgtcgtatttataatatgtggaggagagagagctcaccatgctcaggtaaagggatggtatgtgcaccacaaataacaagcagaagcctctgatatgtcagaaccatgctgtcttccatgagacttcctttgtgaagagcatccatttaaaagacttttatgaatacatggtttcaatcaagtccccagagaacacatttgtcttctgagctgctggcagttttgagaatctgatgacctccgaggggaccctgcactcagccatcaaagtgttcctgcccctctggacactcataattcaatggtagatgcaggtggagttgagaacatcacccagcttccccaggagcttcctcagatgatggctgcagcagccgatggtttggggagtatagcgatagacacgacccagctcaacatgtccgtgacagatcccacagcctgggctacagccatgaataacctgggcatggttcccgtagggttgcctggacagcagctcgtgtctgactcaatctgtgtcccaggctttgatccaagcctcaacatgatgactggaatcacccccattaacccaatgataccaggccttggactggtacctcccccaccaccaacagaagtggctgttgtcaaagaaataatccactgcaaaagctgtactctttttcctcaaaatccaaatcttccacctccttccacaagagaacgacctcctgggtgtaagaccgtgtttgtcggaggattaccagaaaatgctactgaggaaattattcaagaagtctttgaacagtgcggtgatattacagcaattcggaaaagcaagaagaatttttgtcacattcgctttgcagaggaattcatggttgataaagccatttacctttctggttataggatgcgattagggtctagcaccgacaaaaaggattcaggccgccttcatgtggactttgcccaggccagggatgacttctatgagtgggaatgcaagcagaggatgcgtgcccgggaggagcggcaccggcgcaagctggaggaggaccggctcaggcccccatccccgcctgccataatgcactactcggagcacgaagccgctctgctggctgaaaagctgaaagatgatagcaagttttcagaggctatcacagtgctgctttcctggattgaacgaggggaagtgaatcggcgctctgcaaaccagttctattccatggtgcagtcggccaacagccacgtccgccggctaatgaatgaaaaagccacccatgagcaagagatggaggaagccaaggagaattttaaaaatgccttaactgggattctcactcaatttgagcagattgtggccgttttcaacgcttctaccagacaaaaagcttgggaccatttctcgaaagcccagcgcaagaacatagacatttggcgaaagcattctgaggagctccggaatgctcaaagtgagcagctcatgggcatccgccgcgaagaagaaatggaaatgtctgatgatgagaactgtgacagccctacaaagaaaatgagagtcgatgaatcagccctggctgcccaggcctacgctctgaaagaggagaatgacagtctccgctggcagctggatgcctacaggaatgaggtggagctgctgaaacaagaaaaagaacagcttttccgaacagaagaaaacctcaccaaggaccagcaactgcagtttctgcagcaaaccatgcaaggcatgcagcagcaattgctaaccatccaggaggagttaaacaacaaaaagtcagaattggaacaagcaaaggaagagcagtcccatacacaagcgttactaaaagtcctgcaggaacaattaaaaggtaccaaggaattggtcgagaccaatggccacagccatgaggattcaaatgaaatcaatgtgttgacagttgcattagtcaaccaagaccgagagaacaatattgagaaaagaagccaaggcttaaaatcagagaaagaagctctgctaataggtatcatatcaacgtttcttcacgtccatccttttggagccaacatagaatatctttggtcatacatgcagcagctggactccaagatatctgcaaatgaaatagaaatgcttttgatgaggctgccacgcatgttcaaacaggaattcacgggtgtgggagccacgctggaaaaaagatggaagctgtgtgcctttgaaggaattaaaactacctaactgcgaagagcaaagcatctctggaaatgaaaccatgtgaacctggccagggcggtgcgacggggaagcaggaggtgtggggttggtccagcacgcaacctttgtggagccatcgaagcctgcctttagttatatctgtggcgttctcttgtaagtggaaatgtaattgtgtaccagtttcttaaaataaacaaagcttcatactgtgacagatctgtttcctatgaaaaccaaacaatgattccacagtcataatgatggcaaaatcttaaaatgtgctacatttgagaatagctcaccaagcaaaatatttaaagttaatgatggtgtagcaatgattgttgctaggctacagagttgtatatgtaatgtatagctgaaatcattaaatgacattttcctgaaagtctttctgttttagtaaaaaaaaaaaaaaaaaaaaaaagaaaaagaaaaagaaaaaaagaaaaaa

SEQ ID NO: 9232 - DNA, 2610 bp, Homo sapiens
gatggacagaagatggaaaaatttcttacatgaatgaaaagcctctgatatgtcagaaccatgctgtcttccatgagacttcctttgtgaagagcatccatttaaaagacttttatgaatacatggtttcaatcaagtccccagagaacacatttgtcttctgagctgctggcagttttgagaatctgatgacctccgaggggaccctgcactcagccatcaaagtgttcctgcccctctggacactcataattcaatggtagatgcaggtggagttgagaacatcacccagcttccccaggagcttcctcagatgatggctgcagcagccgatggtttggggagtatagcgatagacacgacccagctcaacatgtccgtgacagatcccacagcctgggctacagccatgaataacctgggcatggttcccgtagggttgcctggacagcagctcgtgtctgactcaatctgtgtcccaggctttgatccaagcctcaacatgatgactggaatcacccccattaacccaatgataccaggccttggactggtacctcccccaccaccaacagaagtggctgttgtcaaagaaataatccactgcaaaagctgtactctttttcctcaaaatccaaatcttccacctccttccacaagagaacgacctcctgggtgtaagaccgtgtttgtcggaggattaccagaaaatgctactgaggaaattattcaagaagtctttgaacagtgcggtgatattacagcaattcggaaaagcaagaagaatttttgtcacattcgctttgcagaggaattcatggttgataaagccatttacctttctggttataggatgcgattagggtctagcaccgacaaaaaggattcaggccgccttcatgtggactttgcccaggccagggatgacttctatgagtgggaatgcaagcagaggatgcgtgcccgggaggagcggcaccggcgcaagctggaggaggaccggctcaggcccccatccccgcctgccataatgcactactcggagcacgaagccgctctgctggctgaaaagctgaaagatgatagcaagttttcagaggctatcacagtgctgctttcctggattgaacgaggggaagtgaatcggcgctctgcaaaccagttctattccatggtgcagtcggccaacagccacgtccgccggctaatgaatgaaaaagccacccatgagcaagagatggaggaagccaaggagaattttaaaaatgccttaactgggattctcactcaatttgagcagattgtggccgttttcaacgcttctaccagacaaaaagcttgggaccatttctcgaaagcccagcgcaagaacatagacatttggcgaaagcattctgaggagctccggaatgctcaaagtgagcagctcatgggcatccgccgcgaagaagaaatggaaatgtctgatgatgagaactgtgacagccctacaaagaaaatgagagtcgatgaatcagccctggctgcccaggcctacgctctgaaagaggagaatgacagtctccgctggcagctggatgcctacaggaatgaggtggagctgctgaaacaagaaaaagaacagcttttccgaacagaagaaaacctcaccaaggaccagcaactgcagtttctgcagcaaaccatgcaaggcatgcagcagcaattgctaaccatccaggaggagttaaacaacaaaaagtcagaattggaacaagcaaaggaagagcagtcccatacacaagcgttactaaaagtcctgcaggaacaattaaaaggtaccaaggaattggtcgagaccaatggccacagccatgaggattcaaatgaaatcaatgtgttgacagttgcattagtcaaccaagaccgagagaacaatattgagaaaagaagccaaggcttaaaatcagagaaagaagctctgctaataggtatcatatcaacgtttcttcacgtccatccttttggagccaacatagaatatctttggtcatacatgcagcagctggactccaagatatctgcaaatgaaatagaaatgcttttgatgaggctgccacgcatgttcaaacaggaattcacgggtgtgggagccacgctggaaaaaagatggaagctgtgtgcctttgaaggaattaaaactacctaactgcgaagagcaaagcatctctggaaatgaaaccatgtgaacctggccagggcggtgcgacggggaagcaggaggtgtggggttggtccagcacgcaacctttgtggagccatcgaagcctgcctttagttatatctgtggcgttctcttgtaagtggaaatgtaattgtgtaccagtttcttaaaataaacaaagcttcatactgtgacagatctgtttcctatgaaaaccaaacaatgattccacagtcataatgatggcaaaatcttaaaatgtgctacatttgagaatagctcaccaagcaaaatatttaaagttaatgatggtgtagcaatgattgttgctaggctacagagttgtatatgtaatgtatagctgaaatcattaaatgacattttcctgaaagtctttctgttttagt

SEQ ID NO: 9233 - DNA, 1258 bp, Homo sapiens
actataaagccagtatgtgggatttagggatgtgtatccagcgttaagactttttgcatgcagtgaagcctagtgtttgccggagaacacagtgtgaaatatgtgagcatttccatccatcttcacaaatatcttccacctccttccacaagagaacgacctcctgggtgtaagaccgtgtttgtcggaggattaccagaaaatgctactgaggaaattattcaagaagtctttgaacagtgcggtgatattacagcaattcggaaaagcaagaagaatttttgtcacattcgctttgcagaggaattcatggttgataaagccatttacctttctggttataggatgcgattagggtctagcaccgacaaaaaggattcaggccgccttcatgtggactttgcccaggccagggatgacttctatgagtgggaatgcaagcagaggatgcgtgcccgggaggagcggcaccggcgcaagctggaggaggaccggctcaggcccccatccccgcctgccataatgcactactcggagcacgaagccgctctgctggctgaaaagctgaaagatgatagcaagttttcagaggctatcacagtgctgctttcctggattgaacgaggggaagtgaatcggcgctctgcaaaccagttctattccatggtgcagtcggccaacagccacgtccgccggctaatgaatgaaaaagccacccatgagcaagagatggaggaagccaaggagaattttaaaaatgccttaactgggattctcactcaatttgagcagattgtggccgttttcaacgcttctaccagacaaaaagcttgggaccatttctcgaaagcccagcgcaagaacatagacatttggcgaaagcattctgaggagctccggaatgctcaaagtgagcagctcatgggcatccgccgcgaagaagaaatggaaatgtctgatgatgagaactgtgacagccctacaaagaaaatgagagtcgatgaatcaggtgcttaacatacaagtaggcaccatgccactattttctgaagccatatatcccttgtctgaaaaatgaacccagcacttatgtgtcaatgatgtatgtctcctgctaagcccagatcagattcctcaggactgctttactcttgggtttgtttatttgaggagaccaccttcctcacaggatttctattctacaaaccttcacatagcaaaagaagggggcaaggatttgtgtgaatttcttaagttc

SEQ ID NO: 9234 - DNA, 4184 bp, Homo sapiens
gtgtgtgagagtccagccttgggccagagtgccgggtctaggcctggaagcgcgaggcgggcatttcggaagagagtggcgcggcgtggggcgccgcgagggcactacgagcccaggaactgccgcgccggcccgattttccgcggctgtataaggactagcgcttcggtagccggggagctggagggaacctgatttgagatcaattcttggagaacacaaagaagtgtgatggattgaaccagctgccctttgaccctgctaacaacaacgagcccctgcagtttggtagtgccagtggccctctggtcacagaaggcctcattgagaatggaggggaatcaagcaagaaaagaaagagaacaaatactccttcagaaatgatgacagagctaagttcacagttgaggaccacacaatgcaaagagattttagatggctgtgggtctacgaaataggctatgcagccgataacagtagaactctgaacgtggattccactgcaatgacactacctatgtctgatccaactgcatgggccacagcaatgaataatcttggaatggcaccgctgggaattgccggacaaccaattttacctgactttgatcctgctcttggaatgatgactggaattccaccaataactccaatgatgcctggtttgggaatagtacctccaccaattcctccagatatgccagtagtaaaagagatcatacactgtaaaagctgcacgctcttccctccaaatccaaatctcccacctcctgcaacccgagaaagaccaccaggatgcaaaacagtatttgtgggtggtctgcctgaaaatgggacagagcaaatcattgtggaagttttcgagcagtgtggagagatcattgccattcgcaagagcaagaagaacttctgccacattcgctttgctgaggagtacatggtggacaaagccctgtatctgtctggttaccgcattcgcctgggctctagtactgacaagaaggacacaggcagactccacgttgatttcgcacaggctcgagatgacctgtatgagtgggagtgtaaacagcgtatgctagccagagaggagcgccatcgtagaagaatggaagaagaaagattgcgtccaccatctccacccccagtggtccactattcagatcatgaatgcagcattgttgctgaaaaattaaaagatgattccaaattctcagaagctgtacagaccttgcttacctggatagagcgaggagaggtcaaccgtcgtagcgccaataacttctactccatgatccagtcggccaacagccatgtccgccgcctggtgaacgagaaagctgcccatgagaaagatatggaagaagcaaaggagaagttcaagcaggccctttctggaattctcattcaatttgagcagatagtggctgtgtaccattccgcctccaagcagaaggcatgggaccacttcacaaaagcccagcggaagaacatcagcgtgtggtgcaaacaagctgaggaaattcgcaacattcataatgatgaattaatgggaatcaggcgagaagaagaaatggaaatgtctgatgatgaaatagaagaaatgacagaaacaaaagaaactgaggaatcagccttagtatcacaggcagaagctctgaaggaagaaaatgacagcctccgttggcagctcgatgcctaccggaatgaagtagaactgctcaagcaagaacaaggcaaagtccacagagaagatgaccctaacaaagaacagcagctgaaactcctgcaacaagccctgcaaggaatgcaacagcatctactcaaagtccaagaggaatacaaaaagaaagaagctgaacttgaaaaactcaaagatgacaagttacaggtggaaaaaatgttggaaaatcttaaagaaaaggaaagctgtgcttctaggctgtgtgcctcaaaccaggatagcgaataccctcttgagaagaccatgaacagcagtcctatcaaatctgaacgtgaagcactgctagtggggattatctccacattccttcatgttcacccatttggagcaagcattgaatacatctgttcctacttgcaccgtcttgataataagatctgcaccagcgatgtggagtgtctcatgggtagactccagcataccttcaagcaggaaatgactggagttggagccagcctggaaaagagatggaaattctgtggcttcgagggcttgaagctgacctaaatctctttgcctaacaacttgggatcctgaagataaatatgtgttggacaagcatagaaagtgatttatatttttaatggttttcaagtggaagttcctttgaatttgtcagttcattcctggaaaatcttttgagttaaaataaggatcctaggacagcacctcgaactacaggccctaaagagaaattgcctcaaaccacaagtgctgtaacttcctcccctttctgtcaattggttgtctttaaatattgcaaaagtcctgatgctaaacagtatttggagtgttttcagtgtctgtactactgttgtagaccttggtatttttttaaacactgttaactgaaatgttttgatgatttgtatgtgatttgtgtttctaaacttctctttacattaatgttgttactggtgaaaggcatgagagcagcactaagtcctctgtgtaactgccattgtctttccaatccccagtagaccagtaaataaataacacatcagtgtcttctagaaggtgcctgaccaggttcaccttttaaacgacaaagcatggtttgtggctttttgcaaaattactatgaaccaaaagttgacaaatgttccaaagttattttctctaacatatcacattaaagatctgtttcagaattgtaaaaagtacatctagatgtgtttacagaaagcaagtatccagtatgactggcatgtgttcatgctattcagaatcacttgtaaatagtctgcttttaaaggagggcatgttcagttttctgtgaattaaaatatgctcatgtgtgggcacacacgcacaaacacacacacgcacgcacacagtggcagaagggatttatattaatattctttcccctctggccttcttacagtctgttggtccctttgcttctgttgtcagtgtgttgaattgcaaaccgagtactgctgtaaatactatgtttacttcatgctgaatgtttgcaaagacttgatataagtattaatagtaatgaatcaatgaataaataatgagctagggtttgtgaggctttctacaaataggtcagctccacctggagtgcgaattgccagagacaccttggtagtgcccatcggcaaatcgcaatggcagcatgtgagtggaccattcagaaacttctgcttggtggaaagtaaacagagaggatggaggtttggggcgaatgtcctgaggcagagatggtctttattgtgtgtggtggtggttgtggtatttataataatgcaagcataccctcccttgagtctcaattgaagataaaagaatgtactgagcaagcaaagccaatggagagtatttcacaaaaatactttgtaaatgagatgccagtagtgttcaaagttgtatttttaaaagataaatattcctttttatacctcagttttgtgtcctgtttttaatgacttacgctctaagtaatccattagtagttatctcagttccttcctttgggttactagaatgttggaaaaagatgccaagtctgtcttgacaactggaaacagggttccacagcagcccattcgtgctgaaaactggcttccccctgaagcaccctgctgtggcaccagcaggaagctcaggttaattttacactagcttgctcactgatgcatctctcatcaatgctacggaaggctttgattcatcagtctcgggctcttggaatacctaattttaataatatctatgaaatcaagggaaactttccatttacagttatttcttgtttaaataaactaaattaatttttaggggagagcagtaggaaaaagagctaatgcatgcggggtttaatacctaggtgatgggttgaggtgcagcaaaaccaccatggcacacgttcacctatgtaacaaacctgcacatcctgcacatgtaccccggaacttacttaaaa

SEQ ID NO: 9235 - DNA, 4095 bp, Homo sapiens
gtgtgtgagagtccagccttgggccagagtgccgggtctaggcctggaagcgcgaggcgggcatttcggaagagagtggcgcggcgtggggcgccgcgagggcactacgagcccaggaactgccgcgccggcccgattttccgcggctgtataaggactagcgcttcggtagccggggagctggagggaacctgatttgagatcaattcttggagaacacaaagaagtgtgatggattgaaccagctgccctttgaccctgctaacaacaacgagcccctgcagtttggtagtgccagtggccctctggtcacagaaggcctcattgagaatggaggggaatcaagcaagaaaagaaagagaacaaatactccttcagccgataacagtagaactctgaacgtggattccactgcaatgacactacctatgtctgatccaactgcatgggccacagcaatgaataatcttggaatggcaccgctgggaattgccggacaaccaattttacctgactttgatcctgctcttggaatgatgactggaattccaccaataactccaatgatgcctggtttgggaatagtacctccaccaattcctccagatatgccagtagtaaaagagatcatacactgtaaaagctgcacgctcttccctccaaatccaaatctcccacctcctgcaacccgagaaagaccaccaggatgcaaaacagtatttgtgggtggtctgcctgaaaatgggacagagcaaatcattgtggaagttttcgagcagtgtggagagatcattgccattcgcaagagcaagaagaacttctgccacattcgctttgctgaggagtacatggtggacaaagccctgtatctgtctggttaccgcattcgcctgggctctagtactgacaagaaggacacaggcagactccacgttgatttcgcacaggctcgagatgacctgtatgagtgggagtgtaaacagcgtatgctagccagagaggagcgccatcgtagaagaatggaagaagaaagattgcgtccaccatctccacccccagtggtccactattcagatcatgaatgcagcattgttgctgaaaaattaaaagatgattccaaattctcagaagctgtacagaccttgcttacctggatagagcgaggagaggtcaaccgtcgtagcgccaataacttctactccatgatccagtcggccaacagccatgtccgccgcctggtgaacgagaaagctgcccatgagaaagatatggaagaagcaaaggagaagttcaagcaggccctttctggaattctcattcaatttgagcagatagtggctgtgtaccattccgcctccaagcagaaggcatgggaccacttcacaaaagcccagcggaagaacatcagcgtgtggtgcaaacaagctgaggaaattcgcaacattcataatgatgaattaatgggaatcaggcgagaagaagaaatggaaatgtctgatgatgaaatagaagaaatgacagaaacaaaagaaactgaggaatcagccttagtatcacaggcagaagctctgaaggaagaaaatgacagcctccgttggcagctcgatgcctaccggaatgaagtagaactgctcaagcaagaacaaggcaaagtccacagagaagatgaccctaacaaagaacagcagctgaaactcctgcaacaagccctgcaaggaatgcaacagcatctactcaaagtccaagaggaatacaaaaagaaagaagctgaacttgaaaaactcaaagatgacaagttacaggtggaaaaaatgttggaaaatcttaaagaaaaggaaagctgtgcttctaggctgtgtgcctcaaaccaggatagcgaataccctcttgagaagaccatgaacagcagtcctatcaaatctgaacgtgaagcactgctagtggggattatctccacattccttcatgttcacccatttggagcaagcattgaatacatctgttcctacttgcaccgtcttgataataagatctgcaccagcgatgtggagtgtctcatgggtagactccagcataccttcaagcaggaaatgactggagttggagccagcctggaaaagagatggaaattctgtggcttcgagggcttgaagctgacctaaatctctttgcctaacaacttgggatcctgaagataaatatgtgttggacaagcatagaaagtgatttatatttttaatggttttcaagtggaagttcctttgaatttgtcagttcattcctggaaaatcttttgagttaaaataaggatcctaggacagcacctcgaactacaggccctaaagagaaattgcctcaaaccacaagtgctgtaacttcctcccctttctgtcaattggttgtctttaaatattgcaaaagtcctgatgctaaacagtatttggagtgttttcagtgtctgtactactgttgtagaccttggtatttttttaaacactgttaactgaaatgttttgatgatttgtatgtgatttgtgtttctaaacttctctttacattaatgttgttactggtgaaaggcatgagagcagcactaagtcctctgtgtaactgccattgtctttccaatccccagtagaccagtaaataaataacacatcagtgtcttctagaaggtgcctgaccaggttcaccttttaaacgacaaagcatggtttgtggctttttgcaaaattactatgaaccaaaagttgacaaatgttccaaagttattttctctaacatatcacattaaagatctgtttcagaattgtaaaaagtacatctagatgtgtttacagaaagcaagtatccagtatgactggcatgtgttcatgctattcagaatcacttgtaaatagtctgcttttaaaggagggcatgttcagttttctgtgaattaaaatatgctcatgtgtgggcacacacgcacaaacacacacacgcacgcacacagtggcagaagggatttatattaatattctttcccctctggccttcttacagtctgttggtccctttgcttctgttgtcagtgtgttgaattgcaaaccgagtactgctgtaaatactatgtttacttcatgctgaatgtttgcaaagacttgatataagtattaatagtaatgaatcaatgaataaataatgagctagggtttgtgaggctttctacaaataggtcagctccacctggagtgcgaattgccagagacaccttggtagtgcccatcggcaaatcgcaatggcagcatgtgagtggaccattcagaaacttctgcttggtggaaagtaaacagagaggatggaggtttggggcgaatgtcctgaggcagagatggtctttattgtgtgtggtggtggttgtggtatttataataatgcaagcataccctcccttgagtctcaattgaagataaaagaatgtactgagcaagcaaagccaatggagagtatttcacaaaaatactttgtaaatgagatgccagtagtgttcaaagttgtatttttaaaagataaatattcctttttatacctcagttttgtgtcctgtttttaatgacttacgctctaagtaatccattagtagttatctcagttccttcctttgggttactagaatgttggaaaaagatgccaagtctgtcttgacaactggaaacagggttccacagcagcccattcgtgctgaaaactggcttccccctgaagcaccctgctgtggcaccagcaggaagctcaggttaattttacactagcttgctcactgatgcatctctcatcaatgctacggaaggctttgattcatcagtctcgggctcttggaatacctaattttaataatatctatgaaatcaagggaaactttccatttacagttatttcttgtttaaataaactaaattaatttttaggggagagcagtaggaaaaagagctaatgcatgcggggtttaatacctaggtgatgggttgaggtgcagcaaaaccaccatggcacacgttcacctatgtaacaaacctgcacatcctgcacatgtaccccggaacttacttaaaa

SEQ ID NO: 9236 - DNA, 3788 bp, Homo sapiens
gttcacagttgaggaccacacaatgcaaagagattttagatggctgtgggtctacgaaataggctatgcagccgataacagtagaactctgaacgtggattccactgcaatgacactacctatgtctgatccaactgcatgggccacagcaatgaataatcttggaatggcaccgctgggaattgccggacaaccaattttacctgactttgatcctgctcttggaatgatgactggaattccaccaataactccaatgatgcctggtttgggaatagtacctccaccaattcctccagatatgccagtagtaaaagagatcatacactgtaaaagctgcacgctcttccctccaaatccaaatctcccacctcctgcaacccgagaaagaccaccaggatgcaaaacagtatttgtgggtggtctgcctgaaaatgggacagagcaaatcattgtggaagttttcgagcagtgtggagagatcattgccattcgcaagagcaagaagaacttctgccacattcgctttgctgaggagtacatggtggacaaagccctgtatctgtctggttaccgcattcgcctgggctctagtactgacaagaaggacacaggcagactccacgttgatttcgcacaggctcgagatgacctgtatgagtgggagtgtaaacagcgtatgctagccagagaggagcgccatcgtagaagaatggaagaagaaagattgcgtccaccatctccacccccagtggtccactattcagatcatgaatgcagcattgttgctgaaaaattaaaagatgattccaaattctcagaagctgtacagaccttgcttacctggatagagcgaggagaggtcaaccgtcgtagcgccaataacttctactccatgatccagtcggccaacagccatgtccgccgcctggtgaacgagaaagctgcccatgagaaagatatggaagaagcaaaggagaagttcaagcaggccctttctggaattctcattcaatttgagcagatagtggctgtgtaccattccgcctccaagcagaaggcatgggaccacttcacaaaagcccagcggaagaacatcagcgtgtggtgcaaacaagctgaggaaattcgcaacattcataatgatgaattaatgggaatcaggcgagaagaagaaatggaaatgtctgatgatgaaatagaagaaatgacagaaacaaaagaaactgaggaatcagccttagtatcacaggcagaagctctgaaggaagaaaatgacagcctccgttggcagctcgatgcctaccggaatgaagtagaactgctcaagcaagaacaaggcaaagtccacagagaagatgaccctaacaaagaacagcagctgaaactcctgcaacaagccctgcaaggaatgcaacagcatctactcaaagtccaagaggaatacaaaaagaaagaagctgaacttgaaaaactcaaagatgacaagttacaggtggaaaaaatgttggaaaatcttaaagaaaaggaaagctgtgcttctaggctgtgtgcctcaaaccaggatagcgaataccctcttgagaagaccatgaacagcagtcctatcaaatctgaacgtgaagcactgctagtggggattatctccacattccttcatgttcacccatttggagcaagcattgaatacatctgttcctacttgcaccgtcttgataataagatctgcaccagcgatgtggagtgtctcatgggtagactccagcataccttcaagcaggaaatgactggagttggagccagcctggaaaagagatggaaattctgtggcttcgagggcttgaagctgacctaaatctctttgcctaacaacttgggatcctgaagataaatatgtgttggacaagcatagaaagtgatttatatttttaatggttttcaagtggaagttcctttgaatttgtcagttcattcctggaaaatcttttgagttaaaataaggatcctaggacagcacctcgaactacaggccctaaagagaaattgcctcaaaccacaagtgctgtaacttcctcccctttctgtcaattggttgtctttaaatattgcaaaagtcctgatgctaaacagtatttggagtgttttcagtgtctgtactactgttgtagaccttggtatttttttaaacactgttaactgaaatgttttgatgatttgtatgtgatttgtgtttctaaacttctctttacattaatgttgttactggtgaaaggcatgagagcagcactaagtcctctgtgtaactgccattgtctttccaatccccagtagaccagtaaataaataacacatcagtgtcttctagaaggtgcctgaccaggttcaccttttaaacgacaaagcatggtttgtggctttttgcaaaattactatgaaccaaaagttgacaaatgttccaaagttattttctctaacatatcacattaaagatctgtttcagaattgtaaaaagtacatctagatgtgtttacagaaagcaagtatccagtatgactggcatgtgttcatgctattcagaatcacttgtaaatagtctgcttttaaaggagggcatgttcagttttctgtgaattaaaatatgctcatgtgtgggcacacacgcacaaacacacacacgcacgcacacagtggcagaagggatttatattaatattctttcccctctggccttcttacagtctgttggtccctttgcttctgttgtcagtgtgttgaattgcaaaccgagtactgctgtaaatactatgtttacttcatgctgaatgtttgcaaagacttgatataagtattaatagtaatgaatcaatgaataaataatgagctagggtttgtgaggctttctacaaataggtcagctccacctggagtgcgaattgccagagacaccttggtagtgcccatcggcaaatcgcaatggcagcatgtgagtggaccattcagaaacttctgcttggtggaaagtaaacagagaggatggaggtttggggcgaatgtcctgaggcagagatggtctttattgtgtgtggtggtggttgtggtatttataataatgcaagcataccctcccttgagtctcaattgaagataaaagaatgtactgagcaagcaaagccaatggagagtatttcacaaaaatactttgtaaatgagatgccagtagtgttcaaagttgtatttttaaaagataaatattcctttttatacctcagttttgtgtcctgtttttaatgacttacgctctaagtaatccattagtagttatctcagttccttcctttgggttactagaatgttggaaaaagatgccaagtctgtcttgacaactggaaacagggttccacagcagcccattcgtgctgaaaactggcttccccctgaagcaccctgctgtggcaccagcaggaagctcaggttaattttacactagcttgctcactgatgcatctctcatcaatgctacggaaggctttgattcatcagtctcgggctcttggaatacctaattttaataatatctatgaaatcaagggaaactttccatttacagttatttcttgtttaaataaactaaattaatttttaggggagagcagtaggaaaaagagctaatgcatgcggggtttaatacctaggtgatgggttgaggtgcagcaaaaccaccatggcacacgttcacctatgtaacaaacctgcacatcctgcacatgtaccccggaacttacttaaaa

SEQ ID NO: 9237 - DNA, 3956 bp, Homo sapiens
gtgtgtgagagtccagccttgggccagagtgccgggtctaggcctggaagcgcgaggcgggcatttcggaagagagtggcgcggcgtggggcgccgcgagggcactacgagcccaggaactgccgcgccggcccgattttccgcggctgtataaggactagcgcttcggtagccggggagctggagggaacctgatttgagatcaattcttggagaacacaaagaagtgtgatgccgataacagtagaactctgaacgtggattccactgcaatgacactacctatgtctgatccaactgcatgggccacagcaatgaataatcttggaatggcaccgctgggaattgccggacaaccaattttacctgactttgatcctgctcttggaatgatgactggaattccaccaataactccaatgatgcctggtttgggaatagtacctccaccaattcctccagatatgccagtagtaaaagagatcatacactgtaaaagctgcacgctcttccctccaaatccaaatctcccacctcctgcaacccgagaaagaccaccaggatgcaaaacagtatttgtgggtggtctgcctgaaaatgggacagagcaaatcattgtggaagttttcgagcagtgtggagagatcattgccattcgcaagagcaagaagaacttctgccacattcgctttgctgaggagtacatggtggacaaagccctgtatctgtctggttaccgcattcgcctgggctctagtactgacaagaaggacacaggcagactccacgttgatttcgcacaggctcgagatgacctgtatgagtgggagtgtaaacagcgtatgctagccagagaggagcgccatcgtagaagaatggaagaagaaagattgcgtccaccatctccacccccagtggtccactattcagatcatgaatgcagcattgttgctgaaaaattaaaagatgattccaaattctcagaagctgtacagaccttgcttacctggatagagcgaggagaggtcaaccgtcgtagcgccaataacttctactccatgatccagtcggccaacagccatgtccgccgcctggtgaacgagaaagctgcccatgagaaagatatggaagaagcaaaggagaagttcaagcaggccctttctggaattctcattcaatttgagcagatagtggctgtgtaccattccgcctccaagcagaaggcatgggaccacttcacaaaagcccagcggaagaacatcagcgtgtggtgcaaacaagctgaggaaattcgcaacattcataatgatgaattaatgggaatcaggcgagaagaagaaatggaaatgtctgatgatgaaatagaagaaatgacagaaacaaaagaaactgaggaatcagccttagtatcacaggcagaagctctgaaggaagaaaatgacagcctccgttggcagctcgatgcctaccggaatgaagtagaactgctcaagcaagaacaaggcaaagtccacagagaagatgaccctaacaaagaacagcagctgaaactcctgcaacaagccctgcaaggaatgcaacagcatctactcaaagtccaagaggaatacaaaaagaaagaagctgaacttgaaaaactcaaagatgacaagttacaggtggaaaaaatgttggaaaatcttaaagaaaaggaaagctgtgcttctaggctgtgtgcctcaaaccaggatagcgaataccctcttgagaagaccatgaacagcagtcctatcaaatctgaacgtgaagcactgctagtggggattatctccacattccttcatgttcacccatttggagcaagcattgaatacatctgttcctacttgcaccgtcttgataataagatctgcaccagcgatgtggagtgtctcatgggtagactccagcataccttcaagcaggaaatgactggagttggagccagcctggaaaagagatggaaattctgtggcttcgagggcttgaagctgacctaaatctctttgcctaacaacttgggatcctgaagataaatatgtgttggacaagcatagaaagtgatttatatttttaatggttttcaagtggaagttcctttgaatttgtcagttcattcctggaaaatcttttgagttaaaataaggatcctaggacagcacctcgaactacaggccctaaagagaaattgcctcaaaccacaagtgctgtaacttcctcccctttctgtcaattggttgtctttaaatattgcaaaagtcctgatgctaaacagtatttggagtgttttcagtgtctgtactactgttgtagaccttggtatttttttaaacactgttaactgaaatgttttgatgatttgtatgtgatttgtgtttctaaacttctctttacattaatgttgttactggtgaaaggcatgagagcagcactaagtcctctgtgtaactgccattgtctttccaatccccagtagaccagtaaataaataacacatcagtgtcttctagaaggtgcctgaccaggttcaccttttaaacgacaaagcatggtttgtggctttttgcaaaattactatgaaccaaaagttgacaaatgttccaaagttattttctctaacatatcacattaaagatctgtttcagaattgtaaaaagtacatctagatgtgtttacagaaagcaagtatccagtatgactggcatgtgttcatgctattcagaatcacttgtaaatagtctgcttttaaaggagggcatgttcagttttctgtgaattaaaatatgctcatgtgtgggcacacacgcacaaacacacacacgcacgcacacagtggcagaagggatttatattaatattctttcccctctggccttcttacagtctgttggtccctttgcttctgttgtcagtgtgttgaattgcaaaccgagtactgctgtaaatactatgtttacttcatgctgaatgtttgcaaagacttgatataagtattaatagtaatgaatcaatgaataaataatgagctagggtttgtgaggctttctacaaataggtcagctccacctggagtgcgaattgccagagacaccttggtagtgcccatcggcaaatcgcaatggcagcatgtgagtggaccattcagaaacttctgcttggtggaaagtaaacagagaggatggaggtttggggcgaatgtcctgaggcagagatggtctttattgtgtgtggtggtggttgtggtatttataataatgcaagcataccctcccttgagtctcaattgaagataaaagaatgtactgagcaagcaaagccaatggagagtatttcacaaaaatactttgtaaatgagatgccagtagtgttcaaagttgtatttttaaaagataaatattcctttttatacctcagttttgtgtcctgtttttaatgacttacgctctaagtaatccattagtagttatctcagttccttcctttgggttactagaatgttggaaaaagatgccaagtctgtcttgacaactggaaacagggttccacagcagcccattcgtgctgaaaactggcttccccctgaagcaccctgctgtggcaccagcaggaagctcaggttaattttacactagcttgctcactgatgcatctctcatcaatgctacggaaggctttgattcatcagtctcgggctcttggaatacctaattttaataatatctatgaaatcaagggaaactttccatttacagttatttcttgtttaaataaactaaattaatttttaggggagagcagtaggaaaaagagctaatgcatgcggggtttaatacctaggtgatgggttgaggtgcagcaaaaccaccatggcacacgttcacctatgtaacaaacctgcacatcctgcacatgtaccccggaacttacttaaaaaataa

SEQ ID NO: 9238 - DNA, 4095 bp, Homo sapiens; identical to SEQ ID NO: 9235

SEQ ID NO: 9239 - DNA, 1515 bp, Homo sapiens
gccgggtctaggcctggaagcgcgaggcgggcatttcggaagagagtggcgcggcgtggggcgccgcgagggcactacgagcccaggaactgccgcgccggcccgattttccgcggctgtataaggactagcgcttcggtagccggggagctggagggaacctgatttgagatcaattcttggagaacacaaagaagtgtgatggattgaaccagctgccctttgaccctgctaacaacaacgagcccctgcagtttggtagtgccagtggccctctggtcacagaaggcctcattgagaatggaggggaatcaagcaagaaaagaaagagaacaaatactccttcagccgataacagtagaactctgaacgtggattccactgcaatgacactacctatgtctgatccaactgcatgggccacagcaatgaataatcttggaatggcaccgctgggaattgccggacaaccaattttacctgactttgatcctgctcttggaatgatgactggaattccaccaataactccaatgatgcctggtttgggaatagtacctccaccaattcctccagatatgccagtagtaaaagagatcatacactgtaaaagctgcacgctcttccctccaaatccaaatctcccacctcctgcaacccgagaaagaccaccaggatgcaaaacagtatttgtgggtggtctgcctgaaaatgggacagagcaaatcattgtggaagttttcgagcagtgtggagagatcattgccattcgcaagagcaagaagaacttctgccacattcgctttgctgaggagtacatggtggacaaagccctgtatctgtctggttaccgcattcgcctgggctctagtactgacaagaaggacacaggcagactccacgttgatttcgcacaggctcgagatgacctgtatgagtgggagtgtaaacagcgtatgctagccagagaggagcgccatcgtagaagaatggaagaagaaagattgcgtccaccatctccacccccagtggtccactattcagatcatgaatgcagcattgttgctgaaaaattaaaagatgattccaaattctcagaagctgtacagaccttgcttacctggatagagcgaggagaggtcaaccgtcgtagcgccaataacttctactccatgatccagtcggccaacagccatgtccgccgcctggtgaacgagaaagctgcccatgagaaagatatggaagaagcaaaggagaagttcaagcaggccctttctggaattctcattcaatttgagcagatagtggctgtgtaccattccgcctccaagcagaaggcatgggaccacttcacaaaagcccagcggaagaacatcagcgtgtggtgcaaacaagctgaggaaattcgcaacattcataatgatgaattaatgggaatcaggcgagaagaagaaatggaaatgtctgatgatgaaatagaagaaatgacagaaacaaaagaaactgaggaatcag

SEQ ID NO: 9240 - DNA, 1912 bp, Homo sapiens
gtgtgtgagagtccagccttgggccagagtgccgggtctaggcctggaagcgcgaggcgggcatttcggaagagagtggcgcggcgtggggcgccgcgagggcactacgagcccaggaactgccgcgccggcccgattttccgcggctgtataaggactagcgcttcggtagccggggagctggagggaacctgatttgagatcaattcttggagaacacaaagaagtgtgatggattgaaccagctgccctttgaccctgctaacaacaacgagcccctgcagtttggtagtgccagtggccctctggtcacagaaggcctcattgagaatggaggggaatcaagcaagaaaagaaagagaacaaatactccttcagaaatgatgacagagctaagttcacagttgaggaccacacaatgcaaagagattttagatggctgtgggtctacgaaataggctatgcagccgataacagtagaactctgaacgtggattccactgcaatgacactacctatgtctgatccaactgcatgggccacagcaatgaataatcttggaatggcaccgctgggaattgccggacaaccaattttacctgactttgatcctgctcttggaatgatgactggaattccaccaataactccaatgatgcctggtttgggaatagtacctccaccaattcctccagatatgccagtagtaaaagagatcatacactgtaaaagctgcacgctcttccctccaaatccaaatctcccacctcctgcaacccgagaaagaccaccaggatgcaaaacagtatttgtgggtggtctgcctgaaaatgggacagagcaaatcattgtggaagttttcgagcagtgtggagagatcattgccattcgcaagagcaagaagaacttctgccacattcgctttgctgaggagtacatggtggacaaagccctgtatctgtctggttaccgcattcgcctgggctctagtactgacaagaaggacacaggcagactccacgttgatttcgcacaggctcgagatgacctgtatgagtgggagtgtaaacagcgtatgctagccagagaggagcgccatcgtagaagaatggaagaagaaagattgcgtccaccatctccacccccagtggtccactattcagatcatgaatgcagcattgttgctgaaaaattaaaagatgattccaaattctcagaagctgtacagaccttgcttacctggatagagcgaggagaggtcaaccgtcgtagcgccaataacttctactccatgatccagtcggccaacagccatgtccgccgcctggtgaacgagaaagctgcccatgagaaagatatggaagaagcaaaggagaagttcaagcaggccctttctggaattctcattcaatttgagcagatagtggctgtgtaccattccgcctccaagcagaaggcatgggaccacttcacaaaagcccagcggaagaacatcagcgtgtggtgcaaacaagctgaggaaattcgcaacattcataatgatgaattaatgggaatcaggcgagaagaagaaatggaaatgtctgatgatgaaatagaagaaatgacagaaacaaaagaaactgaggaatcagccttagtatcacaggcagaagctctgaaggaagaaaatgacagcctccgttggcagctcgatgcctaccggaatgaagtagaactgctcaagcaagaacaaggcaaagtccacagagaagatgaccctaacaaagaacagcagctgaaactcctgcaacaagccctgcaaggaatgcaacagcatctactcaaagtccaagaggaatacaaaaagaaagaagctgaacttgaaaaactcaaagatgacaagttacaggtggaaaaaatgaaaaaatga

SEQ ID NO: 9241 - DNA, 12589 bp, Homo sapiens
agggaagaagggagaaagagagagagatttgaatatacattgcttcaaggatgcaaaaaattacaacctggaaaaggcttcgagtaactttaggaaaatgagctgctggactcctcagtcaatctgtcctttctagtcaatgaaaaagacagggtttgaggttccttccgaaacggggccggctaatttagcccctcccacgagcccaagggtctgttatatctctgtttccttgaggacctctctcacggagacggaccacagcaagcagaggctgggggggggaaagacgaggaaagaggaggaaaacaaaagctgctacttatggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatataaaaacttaataaagctgtggaaaggaactcttaatcttcttttctgctacttaggttaaattcactagatcttgattaggaatcaaaattcgaattgggacatgttcaaattctttcttgtggtagttgcctatactgtcatcgctgctgttggttgagcatttgtggtgtaccacgctgtgtgctcaagggtattacattcatcttctcatttaatcctcacaacaatctgaagaaggtaggtattacaattcccacttcatagaaacagaaactgaggttcagagaggttaagtcatttgcccaaatggctgagccaaagcctaccatgtacctaacctttattttctttcccgaacataccaggctgtctcctcataacttccaagcatgcacttaaaactccacatgaatacaaggttcatgggacttggtattcatagaaagggaggcagaaagctggtctgttcctgataggcttgtaatttaatatcattctgttcatgtgctttggatggaagcacatctggcatatgatgctaatcagtggttcccatacccctggcttcctaattttaatgtttgctcacagcatagtagattgacatcaaatagtggccgatgatgatgaaaataaaggtcaaataagttgagccaataacagccgcttttttccttctgtctgcgtatacaaagcactgtcatgcacacaatctattctgaccctcacaacaacccataagggtgtaaatagtatttccattttacaaatgaggatcacacaaactactacatggcagagcagatactccaactcatgtcttctggttgaagcctattgctttttcttttctaaacactttccctcagcaagttggaattagacttcacaagtctccttcagagaacacaaatcttttcttattccattcctgtttggttgcctacgtccaatctccccctccccagagatgccaaaaaaaaaatcctttaaggtatttgggagccaaactcaacttgttaaaatctcaaattatggagacaatcagcagacacaacctaaccccaattattttggcaggaaggttggtttagaggcagatccagcaatctgctttgggccactctgggtggggtaggtgaaataagattggtcactgttaactaattttaatattggattggccattggttatcactgattaccattctcccctggattttcacccaggactcaaaacttggttctgctaaccctgttcctttatgaggaaccttttaaagattcctttataaggtgggagttttttttctatgaacctataggggagaaaaaagatcagcagaagtcattacttttttttttttttttttttttttttgagagagagtctcactccattgcccaggctggagtgcagtggtgctatctcggctcactgcaacctccgcctcctgggttcaagcaattctcctgcctcagcctcccgagtagctgggattgcaggtgcccaccaccacacccggctaatttttgtatttttagtaaagacagggtttcaccatgttggccaggctggtctccaactcccaatctcaggtgatcctattgcctcgggctcccaaagtgctgggattacaggagtgagccaccatgcctggccagaagtggttacttctgtagacaaaagaataatgctacttaatcaggctttctgtgtgacaagaaagagaaagaaaataaagaagtttcaattcatccaattcttaataagaaatatgtaaataaaattttttaaaattacacttcattttaatgttgtatcagtcaaggtccctgcaagagatggatggtatggtacactcaaactgggtaacacaggagagttttcagaaagcaactaaatccaaaatactatcaaggaatcaatataaaaattgttaatatttttctcatactaaattttcaaaatattttgtgtctattacatttacagcacatcttaattaggactagctgtgtgttcacctcacatgtggcttgtagctaccatactggacagcacatgtccaaaaaaatacacgtaaagttaaagtttaaaagacacaggaactaagccctcattgtctttcccttgggaggtagtttaaagagctatagatgctgtaacattcttgctattatttattatatatgacattattcctaaaaaagcttttgagatcctaggttgtattcctcaggttttgttgccttcccatgaagatgtgaaggcagggatgcctgttattcagtccaagatgcatgacaagagaccttgggaaagtttcatctggatttaaagattaattcttgatgcttacattccatactcaaaatgtaaatttgaatattaaaataaagatgattttttttttggagctagtcttgctctgttgcccaggctggaatgcagtggcatgatcatggctcactgcagcctcgacctcccaagctcaagcaaggctacaggtgtgcacctaagtagctaggactacaggtgtgcaccaccatgtctagctatttttttttctgtagagacagggttttcctatgttgtccaggctggtctcgaactcctgccctcaagcaatcctcctgccttggcctcccaaagtgttgagattacaggcgtaagccactgcacctggccaagatgaatattttaatagctcacagaacaaagtttgccacataatgataaaattactatgaaaatatattccctttattgtcagtttaaaagatgaactgagtttcacccaaactggtctggcccctctctgattcaaataccaatagttgctctgattcaaattccaactgttagaacatgacagctgctcataactagctttgcttactaaccatgtttctttccatttgtattaggtcctttactttttataacagcctcaaagtttcatgaattgctgcagtaaacattgattttcatgtttgtgagtctgcaagccagctgggcagctctacttcaggtggtaagggtggatcagacctattccatatacctcttgttctccttgtccagtggtttctagggatatgttctcatgatgaaccccgcagaggctcgtgaaagtgagaggaaactaggatgcctcttaaggtcttggtcaggatggggtctcctgtcacttctgtcacaggctattgtaagtcatatgagcaagctcaataaaatataaacaagtcagataaacagtgggaggaatggcaaagtcatatggccaaggccatgagtgattaattttaacacaggaaaaaagtaaagcattaaatgcgattatttaatatacaatgtcttattaactgaaatataaaatgtgtttactgtaaaatataatctgtttatctcaccaaagaaatattatctttaaaaaatgtcattacttctaagacatcatcagtctgcaacttctttccatagccttaatcaggatgctgtggcagctcccacattagcctcgcattctaaactggtagatgtcctaggaaaccatacatctatgtatttttcttattttatacgtttaggacaatgtatagctaattacccaactttttatttgcatacaaatctaatacaactgaacacaatcagttttatcacaggtataatggatttttcaatagtgaggaggtgcctccatgagccttctctttagaaaagtggcattcaagactcttcatttgaagtgaagattgctatgtcttttgcattgctctattttacataaattaagttataaattgacactataatcaactgacaccatgatcagtgatgatgatcaccctcatcagcactagagttgacttgtttttataacccctttgcatgtatgttgaatagcaaagttcatcagagaacatgtattagtcaatggtaagtaagatactctcatctaagaaataacatcacctcttctaatgaagttctaagaagagagggaagaaaaagtcttgggagctagtcagggaatagtgtgtatttgcaattacctaaactgaactctaccattactcctaacccagttcctcctcctgtgttttacatgattaatgccacccctgcctcaatgaaccaagatcagctccatcactgggacctccccattctgcctgtgcaatatttttcttttttatttctccttctaatattactgttattgctccagtaaagagctgtaatatattttacctggactgataccaggaatggtggtgttgcttccaatctgttgctgctagattaatctttgcaaagcacaggcttaatttcattgctgctcaactaaaaccactggtggctttccattgcctacaaaataaagtcaacctccccatcagacattcaaggctttcaatgatccatggccgccagctctctccaggctcatatcccactccactcctctgatgtttcctacactacactacactatactacactacagccaggtagaatgactgttcacccaacaccactcaggttgtcttctcaacttggaatactcttgcaccttcaaagctcatttcaaatgccccttcatttgtgaagccttctccaaatttccaagtcagaatgtctcttccttgtgctaccacaaccctttaactgagcctccattagtgcactgagaccattctgttcagtgtctgggtgaagcttcctggtgaaaaatatgttacctatttctttctgaaaagttggattcagggatattatcacggacctaaggtaatagttctagccaacctccctgtccactgccaggccgactacaaacccttctgttgctggcgagctggtccgcaccactagttctgcttcactctatttatctcttgatgtaaccatcttctttctccaggttttaagaaccagcccaactcctggttccctgatgaagcttttattcccctagccacatggaacttttcctttttggaacatgcctttagtttctgtgtagtttgccatgcagcacttcattgtacacattattaaaacagaattttaaggattagaatgaaccttaaaagatcatgcatctcaaaatttaatgtacatacaaattacccagggattttgttgaaataaaaattatttaattttaattaatataaataattcagtaggtctggggtgaggcctgaggttttacatttccaacaagctgccaggtaaagccaatacatctgtccaggaatcacactttgcgtatcaaaggtctagatgacattatcattccaaagagtttcttttacaggctctcagatcagtgttcatccactacctgactactgtcattcacaggcattctgttccacagcaggccagctaacgtggtatttacaaagctcactcctcttatacaacaatccaagtgtttcttttgtcagttgtctgtgccccaggagatccctctctgccttgccttgccctctgcctttggagaccagcacctcatactcagtgaaggcctggagtgcttaagagggatttcttccagctctcttgccctggtcttcagtgtattagatgtattacctccatgctctcagtagaggcccataggaaagagtaggtaggttatgccagctcacacgcatcctttaaaaatggtttagaagtttagctggtttcttattactcctgtctatggatgtttccttctgtcactctactagggatgaaacagctaatcatgttcaatagttacatttagattggtttttaaaaactatgattgtattagttcgtttccatgctgctgataaagacatatctgagactggaaacaaaaagggtttaattggacttacagttccacatggctggggaggcctcaaaatcaggtgggaggcaaaaggtacttcttacgtggtggcatcaagagcaaaatgaggaagaagcaaaagcagaaactcttcataaacccaccagatcttgtgggacttattatcacgagaatagcacagaaaagactggcctccatgattcaattacctcccactgcgtccctcccacaacatgtgggaattctgggagatacaattcaagttgagatttgggtggggacacagccaaaccatatcattcctccctgggctcctccaaatttcataatcctcacatttcaaaaccaatcattccttcccaacagttccccaaagtcttaactcatttcagcattaacccaaaagtccacagtccaaagtctcatctgagacaaggcaagtcccttccacttacaagcctgtaaaagcaagctagttacctcctagatacaatggggggtacaggtattgggtaaatacagctgttccaaatgagagaaattggccaaaacaaaggggttacagggtccatgcaagtctgaaatccagtggggcagtcaaattttaaagctccataatgatctcctttgactccatgtctcacattcaggtcatgctgatgcaagagataggttcccatggtcttgtgcagctccgcccctgtggctttgcagagtacagcctccctcctggctgctttctcaggctgatgttgagtgtctgtagcttttccaggcacaagatgcaagttggtggttgatctaccattctggggtctaccattctggggtctaccgttctgggactgtggccttcttctcacagctccactaggcagtgccccaacagggactctgtgtgggggctctgccccacatttcccttccacactgccctaggagaggttccccatgagggctctgcccctgcagcaaacttttgcctggacatccaggtgtttccatatatattctgaaatctaggcagaggttcccaaatctcaattcttgacatctctgcacccacaggctcaacatcacatggaagctgccaatgcttggggcctctaccctctgaagccacagcccaagctctatgttggctcctttcagccatggctggagcagctgggacacagggcaccaagtccctaggctgcacacagcacagagaccctgggcccagcccacaaaaccactttttcctcctgggcctctgggcctgtgatgggaggggctgccatgaaggtctctgacatgacctggagacattttccccatggtcttggggattaacattaggctccttgctgcttatgcaaatttctgcagccagcttgaatttctccttaaaaaaaatgggtttttcttttctactgcatcatcaggctgcagattttccacatttatgctcttgtttcccttttaaaacagaatgtttttaacagcacccaagtcaccttttgaatgctttgctgcttagaaatttattccaccagataccctaagtcatctctctcaagctctaagttccacaaatctctagggcaagggtgaaatgctgccagtctccttgctaaaacataacaagggtcacctttacttcagttcccaacaaggtcttcatctccatctgagaccacctcagcctggaccttattgttcatatcactatcagtatttttgtcaatgccattcacagtctctaggaggttccaaactttcctacattttcctatcttcttctgagccctccagattatttcaacacccagttccaaagttgcttccacattttcgggtatcttttcagcaatgccccactctactggtactattagtccattttcatgctgctgataaagacatacctgagactgggaacaaaaagaggtttaattggacttatagttccacctggctggggaggcctcagaatcatggcaggaggtgaaaggcatttcttacacggcagcagcaagagaaaaatgaagaagcagcaaaagcagaaacccctgataaaaccatcagatctcgtgagacttattcactatcacaagaatagcatgggaaagaccagcccccttgattcaattacctccccctgggtcctgtgggaattctggaaggtacaattcaagttgagatttgggtggggacacagccaaaccatatcaatgattttgtactttaaccagctgaatggaagtacaatctcttgctatatgacacaataattatttgcaaaatgagtaaacatatcataaggaaattatttttacaaggtttgaaacctgaaatgcagtctattatcatacataactaaaaatagagcctcaataaacagattcccagttttgaaaatgcaacatttgtactccacattgtcagttttcttaggtatatttataaatactcctataaaaatgtaaagaaacacataatgtagattgctaattttataataacacaagttgattttgacatccaacttattaattatgaaatgacttttggcctagtaacaatgaaaatgggggcaaatacagataaatggtaattcttagaatgaactactcagcaccaattctaagtttttcttgatggtaaatcataatgttccctttctcctcggttctgcaatctataggcataccataattgtaatcaatagcttaaaaatatgtctctctgtcctattctgtatctgtatctcttggatttttacctttgcaatagtcaactgaaccatcttcttggagtactcatgaagatggaagtctacatggagaatacaggatgaatccactctgtctcctgcagtgaagtctgtttgaaggatgtatttggctgtcttctggacaggccattctaataacagaaacaaacaagttattttaaaacttattggaatattcaaatattaaccaaagtagaaaaatataatacacatccatgtgcccatcacagaacttcactgattatcatcatttagccagtcttgaagaagcaagtgctaattacaatcacaaatgaaacaagattcagacttcatgaagagcactgcgctataataaaagaagaaatgagcacatacattcttttactgacagtcaaatggtgaaggtgggcagaatcattatgtgatgcaacatggcaaaagtatacagacagtgcatccagaggaaggcaccttgctgaatgactagaatggaagtaggagacattttgcaggcccccttcatcctgcagggagaaccagaaccacagcagctctatttgcctattcctctttaaattacaaagttaaaatttgggagtagtagaaaatcaattggttatcttatagagtctcctagaatatttcattggcattgagaaggtggaaaatgcaaattatatactttaaaatgtaatttttgcttttcacatatgcttaaagcctaaaacctcttaataaacttcttctgaaatata

SEQ ID NO: 9242 - DNA, 2035 bp, Homo sapiens
gcttcaaggatgcaaaaaattacaacctggaaaaggcttcgagtaactttaggaaaatgagctgctggactcctcagtcaatctgtcctttctagtcaatgaaaaagacagggtttgaggttccttccgaaacggggccggctaatttagcccctcccacgagcccaagggtctgttatatctctgtttccttgaggacctctctcacggagacggaccacagcaagcagaggctgggggggggaaagacgaggaaagaggaggaaaacaaaagctgctacttatggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttc

SEQ ID NO: 9243 - DNA, 1452 bp, Homo sapiens
gtgtacgtgtaaaattatgatcaaataaatttgtatgccttttctcctattaacctgccttttttgtcagcgattgtcagtgaaacttcagagggcaaaggggaagttttccttggcccctccagttttggtgctgtgaacaggataccaaagctgctctgttcttctggaagctgcaatgaagggaaccaaggacctgacaagccagcagaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggcaagtataactcaatccagacctgcccccttcacatctgcacctccagcccccacatcctgttgttttctgtttcaaattcagtagtttgtctgaacttggttattgtactttccaaacctttttaggcaggatattgaactacatctggttgacccctataaattgtttcagtcagacatcccctcccatgtttgtttactgcgttatctccacagacacaactgagatcttctctcaggaaataatttctccccctcgtggggttgataatgaaaattatgtggtagaatattgtttgttggagggggaattgcaatttataagctcttttagaccactttttaaagctccctttcctacaaactacaaaaaaacagagttgttagaaatgacctggagaggagaaggaaaaaaaaaaaaacacttcaggagaaaca

SEQ ID NO: 9244 - DNA, 12515 bp, Homo sapiens
cctgttgctctttgctctaatgagccttgagaaaggattgctggtcatgggaccagaggctttatggggagggaagaactgttcttgactttcagtttttcgagcgggtttcaagagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatataaaaacttaataaagctgtggaaaggaactcttaatcttcttttctgctacttaggttaaattcactagatcttgattaggaatcaaaattcgaattgggacatgttcaaattctttcttgtggtagttgcctatactgtcatcgctgctgttggttgagcatttgtggtgtaccacgctgtgtgctcaagggtattacattcatcttctcatttaatcctcacaacaatctgaagaaggtaggtattacaattcccacttcatagaaacagaaactgaggttcagagaggttaagtcatttgcccaaatggctgagccaaagcctaccatgtacctaacctttattttctttcccgaacataccaggctgtctcctcataacttccaagcatgcacttaaaactccacatgaatacaaggttcatgggacttggtattcatagaaagggaggcagaaagctggtctgttcctgataggcttgtaatttaatatcattctgttcatgtgctttggatggaagcacatctggcatatgatgctaatcagtggttcccatacccctggcttcctaattttaatgtttgctcacagcatagtagattgacatcaaatagtggccgatgatgatgaaaataaaggtcaaataagttgagccaataacagccgcttttttccttctgtctgcgtatacaaagcactgtcatgcacacaatctattctgaccctcacaacaacccataagggtgtaaatagtatttccattttacaaatgaggatcacacaaactactacatggcagagcagatactccaactcatgtcttctggttgaagcctattgctttttcttttctaaacactttccctcagcaagttggaattagacttcacaagtctccttcagagaacacaaatcttttcttattccattcctgtttggttgcctacgtccaatctccccctccccagagatgccaaaaaaaaaatcctttaaggtatttgggagccaaactcaacttgttaaaatctcaaattatggagacaatcagcagacacaacctaaccccaattattttggcaggaaggttggtttagaggcagatccagcaatctgctttgggccactctgggtggggtaggtgaaataagattggtcactgttaactaattttaatattggattggccattggttatcactgattaccattctcccctggattttcacccaggactcaaaacttggttctgctaaccctgttcctttatgaggaaccttttaaagattcctttataaggtgggagttttttttctatgaacctataggggagaaaaaagatcagcagaagtcattacttttttttttttttttttttttttttgagagagagtctcactccattgcccaggctggagtgcagtggtgctatctcggctcactgcaacctccgcctcctgggttcaagcaattctcctgcctcagcctcccgagtagctgggattgcaggtgcccaccaccacacccggctaatttttgtatttttagtaaagacagggtttcaccatgttggccaggctggtctccaactcccaatctcaggtgatcctattgcctcgggctcccaaagtgctgggattacaggagtgagccaccatgcctggccagaagtggttacttctgtagacaaaagaataatgctacttaatcaggctttctgtgtgacaagaaagagaaagaaaataaagaagtttcaattcatccaattcttaataagaaatatgtaaataaaattttttaaaattacacttcattttaatgttgtatcagtcaaggtccctgcaagagatggatggtatggtacactcaaactgggtaacacaggagagttttcagaaagcaactaaatccaaaatactatcaaggaatcaatataaaaattgttaatatttttctcatactaaattttcaaaatattttgtgtctattacatttacagcacatcttaattaggactagctgtgtgttcacctcacatgtggcttgtagctaccatactggacagcacatgtccaaaaaaatacacgtaaagttaaagtttaaaagacacaggaactaagccctcattgtctttcccttgggaggtagtttaaagagctatagatgctgtaacattcttgctattatttattatatatgacattattcctaaaaaagcttttgagatcctaggttgtattcctcaggttttgttgccttcccatgaagatgtgaaggcagggatgcctgttattcagtccaagatgcatgacaagagaccttgggaaagtttcatctggatttaaagattaattcttgatgcttacattccatactcaaaatgtaaatttgaatattaaaataaagatgattttttttttggagctagtcttgctctgttgcccaggctggaatgcagtggcatgatcatggctcactgcagcctcgacctcccaagctcaagcaaggctacaggtgtgcacctaagtagctaggactacaggtgtgcaccaccatgtctagctatttttttttctgtagagacagggttttcctatgttgtccaggctggtctcgaactcctgccctcaagcaatcctcctgccttggcctcccaaagtgttgagattacaggcgtaagccactgcacctggccaagatgaatattttaatagctcacagaacaaagtttgccacataatgataaaattactatgaaaatatattccctttattgtcagtttaaaagatgaactgagtttcacccaaactggtctggcccctctctgattcaaataccaatagttgctctgattcaaattccaactgttagaacatgacagctgctcataactagctttgcttactaaccatgtttctttccatttgtattaggtcctttactttttataacagcctcaaagtttcatgaattgctgcagtaaacattgattttcatgtttgtgagtctgcaagccagctgggcagctctacttcaggtggtaagggtggatcagacctattccatatacctcttgttctccttgtccagtggtttctagggatatgttctcatgatgaaccccgcagaggctcgtgaaagtgagaggaaactaggatgcctcttaaggtcttggtcaggatggggtctcctgtcacttctgtcacaggctattgtaagtcatatgagcaagctcaataaaatataaacaagtcagataaacagtgggaggaatggcaaagtcatatggccaaggccatgagtgattaattttaacacaggaaaaaagtaaagcattaaatgcgattatttaatatacaatgtcttattaactgaaatataaaatgtgtttactgtaaaatataatctgtttatctcaccaaagaaatattatctttaaaaaatgtcattacttctaagacatcatcagtctgcaacttctttccatagccttaatcaggatgctgtggcagctcccacattagcctcgcattctaaactggtagatgtcctaggaaaccatacatctatgtatttttcttattttatacgtttaggacaatgtatagctaattacccaactttttatttgcatacaaatctaatacaactgaacacaatcagttttatcacaggtataatggatttttcaatagtgaggaggtgcctccatgagccttctctttagaaaagtggcattcaagactcttcatttgaagtgaagattgctatgtcttttgcattgctctattttacataaattaagttataaattgacactataatcaactgacaccatgatcagtgatgatgatcaccctcatcagcactagagttgacttgtttttataacccctttgcatgtatgttgaatagcaaagttcatcagagaacatgtattagtcaatggtaagtaagatactctcatctaagaaataacatcacctcttctaatgaagttctaagaagagagggaagaaaaagtcttgggagctagtcagggaatagtgtgtatttgcaattacctaaactgaactctaccattactcctaacccagttcctcctcctgtgttttacatgattaatgccacccctgcctcaatgaaccaagatcagctccatcactgggacctccccattctgcctgtgcaatatttttcttttttatttctccttctaatattactgttattgctccagtaaagagctgtaatatattttacctggactgataccaggaatggtggtgttgcttccaatctgttgctgctagattaatctttgcaaagcacaggcttaatttcattgctgctcaactaaaaccactggtggctttccattgcctacaaaataaagtcaacctccccatcagacattcaaggctttcaatgatccatggccgccagctctctccaggctcatatcccactccactcctctgatgtttcctacactacactacactatactacactacagccaggtagaatgactgttcacccaacaccactcaggttgtcttctcaacttggaatactcttgcaccttcaaagctcatttcaaatgccccttcatttgtgaagccttctccaaatttccaagtcagaatgtctcttccttgtgctaccacaaccctttaactgagcctccattagtgcactgagaccattctgttcagtgtctgggtgaagcttcctggtgaaaaatatgttacctatttctttctgaaaagttggattcagggatattatcacggacctaaggtaatagttctagccaacctccctgtccactgccaggccgactacaaacccttctgttgctggcgagctggtccgcaccactagttctgcttcactctatttatctcttgatgtaaccatcttctttctccaggttttaagaaccagcccaactcctggttccctgatgaagcttttattcccctagccacatggaacttttcctttttggaacatgcctttagtttctgtgtagtttgccatgcagcacttcattgtacacattattaaaacagaattttaaggattagaatgaaccttaaaagatcatgcatctcaaaatttaatgtacatacaaattacccagggattttgttgaaataaaaattatttaattttaattaatataaataattcagtaggtctggggtgaggcctgaggttttacatttccaacaagctgccaggtaaagccaatacatctgtccaggaatcacactttgcgtatcaaaggtctagatgacattatcattccaaagagtttcttttacaggctctcagatcagtgttcatccactacctgactactgtcattcacaggcattctgttccacagcaggccagctaacgtggtatttacaaagctcactcctcttatacaacaatccaagtgtttcttttgtcagttgtctgtgccccaggagatccctctctgccttgccttgccctctgcctttggagaccagcacctcatactcagtgaaggcctggagtgcttaagagggatttcttccagctctcttgccctggtcttcagtgtattagatgtattacctccatgctctcagtagaggcccataggaaagagtaggtaggttatgccagctcacacgcatcctttaaaaatggtttagaagtttagctggtttcttattactcctgtctatggatgtttccttctgtcactctactagggatgaaacagctaatcatgttcaatagttacatttagattggtttttaaaaactatgattgtattagttcgtttccatgctgctgataaagacatatctgagactggaaacaaaaagggtttaattggacttacagttccacatggctggggaggcctcaaaatcaggtgggaggcaaaaggtacttcttacgtggtggcatcaagagcaaaatgaggaagaagcaaaagcagaaactcttcataaacccaccagatcttgtgggacttattatcacgagaatagcacagaaaagactggcctccatgattcaattacctcccactgcgtccctcccacaacatgtgggaattctgggagatacaattcaagttgagatttgggtggggacacagccaaaccatatcattcctccctgggctcctccaaatttcataatcctcacatttcaaaaccaatcattccttcccaacagttccccaaagtcttaactcatttcagcattaacccaaaagtccacagtccaaagtctcatctgagacaaggcaagtcccttccacttacaagcctgtaaaagcaagctagttacctcctagatacaatggggggtacaggtattgggtaaatacagctgttccaaatgagagaaattggccaaaacaaaggggttacagggtccatgcaagtctgaaatccagtggggcagtcaaattttaaagctccataatgatctcctttgactccatgtctcacattcaggtcatgctgatgcaagagataggttcccatggtcttgtgcagctccgcccctgtggctttgcagagtacagcctccctcctggctgctttctcaggctgatgttgagtgtctgtagcttttccaggcacaagatgcaagttggtggttgatctaccattctggggtctaccattctggggtctaccgttctgggactgtggccttcttctcacagctccactaggcagtgccccaacagggactctgtgtgggggctctgccccacatttcccttccacactgccctaggagaggttccccatgagggctctgcccctgcagcaaacttttgcctggacatccaggtgtttccatatatattctgaaatctaggcagaggttcccaaatctcaattcttgacatctctgcacccacaggctcaacatcacatggaagctgccaatgcttggggcctctaccctctgaagccacagcccaagctctatgttggctcctttcagccatggctggagcagctgggacacagggcaccaagtccctaggctgcacacagcacagagaccctgggcccagcccacaaaaccactttttcctcctgggcctctgggcctgtgatgggaggggctgccatgaaggtctctgacatgacctggagacattttccccatggtcttggggattaacattaggctccttgctgcttatgcaaatttctgcagccagcttgaatttctccttaaaaaaaatgggtttttcttttctactgcatcatcaggctgcagattttccacatttatgctcttgtttcccttttaaaacagaatgtttttaacagcacccaagtcaccttttgaatgctttgctgcttagaaatttattccaccagataccctaagtcatctctctcaagctctaagttccacaaatctctagggcaagggtgaaatgctgccagtctccttgctaaaacataacaagggtcacctttacttcagttcccaacaaggtcttcatctccatctgagaccacctcagcctggaccttattgttcatatcactatcagtatttttgtcaatgccattcacagtctctaggaggttccaaactttcctacattttcctatcttcttctgagccctccagattatttcaacacccagttccaaagttgcttccacattttcgggtatcttttcagcaatgccccactctactggtactattagtccattttcatgctgctgataaagacatacctgagactgggaacaaaaagaggtttaattggacttatagttccacctggctggggaggcctcagaatcatggcaggaggtgaaaggcatttcttacacggcagcagcaagagaaaaatgaagaagcagcaaaagcagaaacccctgataaaaccatcagatctcgtgagacttattcactatcacaagaatagcatgggaaagaccagcccccttgattcaattacctccccctgggtcctgtgggaattctggaaggtacaattcaagttgagatttgggtggggacacagccaaaccatatcaatgattttgtactttaaccagctgaatggaagtacaatctcttgctatatgacacaataattatttgcaaaatgagtaaacatatcataaggaaattatttttacaaggtttgaaacctgaaatgcagtctattatcatacataactaaaaatagagcctcaataaacagattcccagttttgaaaatgcaacatttgtactccacattgtcagttttcttaggtatatttataaatactcctataaaaatgtaaagaaacacataatgtagattgctaattttataataacacaagttgattttgacatccaacttattaattatgaaatgacttttggcctagtaacaatgaaaatgggggcaaatacagataaatggtaattcttagaatgaactactcagcaccaattctaagtttttcttgatggtaaatcataatgttccctttctcctcggttctgcaatctataggcataccataattgtaatcaatagcttaaaaatatgtctctctgtcctattctgtatctgtatctcttggatttttacctttgcaatagtcaactgaaccatcttcttggagtactcatgaagatggaagtctacatggagaatacaggatgaatccactctgtctcctgcagtgaagtctgtttgaaggatgtatttggctgtcttctggacaggccattctaataacagaaacaaacaagttattttaaaacttattggaatattcaaatattaaccaaagtagaaaaatataatacacatccatgtgcccatcacagaacttcactgattatcatcatttagccagtcttgaagaagcaagtgctaattacaatcacaaatgaaacaagattcagacttcatgaagagcactgcgctataataaaagaagaaatgagcacatacattcttttactgacagtcaaatggtgaaggtgggcagaatcattatgtgatgcaacatggcaaaagtatacagacagtgcatccagaggaaggcaccttgctgaatgactagaatggaagtaggagacattttgcaggcccccttcatcctgcagggagaaccagaaccacagcagctctatttgcctattcctctttaaattacaaagttaaaatttgggagtagtagaaaatcaattggttatcttatagagtctcctagaatatttcattggcattgagaaggtggaaaatgcaaattatatactttaaaatgtaatttttgcttttcacatatgcttaaagcctaaaacctcttaataaacttcttctgaaatata

SEQ ID NO: 9245 - DNA, 5044 bp, Homo sapiens
gtgtacgtgtaaaattatgatcaaataaatttgtatgccttttctcctattaacctgccttttttgtcagcgattgtcagtgaaacttcagagggcaaaggggaagttttccttggcccctccagttttggtgctgtgaacaggataccaaagctgctctgttcttctggaagctgcaatgaagggaaccaaggacctgacaagccagcagaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatataaaaacttaataaagctgtggaaaggaactcttaatcttcttttctgctacttaggttaaattcactagatcttgattaggaatcaaaattcgaattgggacatgttcaaattctttcttgtggtagttgcctatactgtcatcgctgctgttggttgagcatttgtggtgtaccacgctgtgtgctcaagggtattacattcatcttctcatttaatcctcacaacaatctgaagaaggtaggtattacaattcccacttcatagaaacagaaactgaggttcagagaggttaagtcatttgcccaaatggctgagccaaagcctaccatgtacctaacctttattttctttcccgaacataccaggctgtctcctcataacttccaagcatgcacttaaaactccacatgaatacaaggttcatgggacttggtattcatagaaagggaggcagaaagctggtctgttcctgataggcttgtaatttaatatcattctgttcatgtgctttggatggaagcacatctggcatatgatgctaatcagtggttcccatacccctggcttcctaattttaatgtttgctcacagcatagtagattgacatcaaatagtggccgatgatgatgaaaataaaggtcaaataagttgagccaataacagccgcttttttccttctgtctgcgtatacaaagcactgtcatgcacacaatctattctgaccctcacaacaacccataagggtgtaaatagtatttccattttacaaatgaggatcacacaaactactacatggcagagcagatactccaactcatgtcttctggttgaagcctattgctttttcttttctaaacactttccctcagcaagttggaattagacttcacaagtctccttcagagaacacaaatcttttcttattccattcctgtttggttgcctacgtccaatctccccctccccagagatgccaaaaaaaaaatcctttaaggtatttgggagccaaactcaacttgttaaaatctcaaattatggagacaatcagcagacacaacctaaccccaattattttggcaggaaggttggtttagaggcagatccagcaatctgctttgggccactctgggtggggtaggtgaaataagattggtcactgttaactaattttaatattggattggccattggttatcactgattaccattctcccctggattttcacccaggactcaaaacttggttctgctaaccctgttcctttatgaggaaccttttaaagattcctttataaggtgggagttttttttctatgaacctataggggagaaaaaagatcagcagaagtcattacttttttttttttttttttttttttttgagagagagtctcactccattgcccaggctggagtgcagtggtgctatctcggctcactgcaacctccgcctcctgggttcaagcaattctcctgcctcagcctcccgagtagctgggattgcaggtgcccaccaccacacccggctaatttttgtatttttagtaaagacagggtttcaccatgttggccaggctggtctccaactcccaatctcaggtgatcctattgcctcgggctcccaaagtgctgggattacaggagtgagccaccatgcctggccagaagtggttacttctgtagacaaaagaataatgctacttaatcaggctttctgtgtgacaagaaagagaaagaaaataaagaagtttcaattcatccaattcttaataagaaatatgtaaataaaattttttaaaattacacttc

SEQ ID NO: 9246 - DNA, 12471 bp, Homo sapiens
agggaagaagggagaaagagagagagatttgaatatacattgcttcaaggatgcaaaaaattacaacctggaaaaggcttcgagtaactttaggaaaatgagctgctggactcctcagtcaatctgtcctttctagtcaatgaaaaagacagggtttgaggttccttccgaaacggggccggctaatttagcccctcccacgagcccaagggtctgttatatctctgtttccttgaggacctctctcacggagacggaccacagcaagcagaggctgggggggggaaagacgaggaaagaggaggaaaacaaaagctgctacttatggaagatacaaaggagtctaacgtgaagacattttgctccaagaatatcctagccatccttggcttctcctctatcatagctgtgatagctttgcttgctgtggggttgacccagaacaaagcattgccagaaaacgttaaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatataaaaacttaataaagctgtggaaaggaactcttaatcttcttttctgctacttaggttaaattcactagatcttgattaggaatcaaaattcgaattgggacatgttcaaattctttcttgtggtagttgcctatactgtcatcgctgctgttggttgagcatttgtggtgtaccacgctgtgtgctcaagggtattacattcatcttctcatttaatcctcacaacaatctgaagaaggtaggtattacaattcccacttcatagaaacagaaactgaggttcagagaggttaagtcatttgcccaaatggctgagccaaagcctaccatgtacctaacctttattttctttcccgaacataccaggctgtctcctcataacttccaagcatgcacttaaaactccacatgaatacaaggttcatgggacttggtattcatagaaagggaggcagaaagctggtctgttcctgataggcttgtaatttaatatcattctgttcatgtgctttggatggaagcacatctggcatatgatgctaatcagtggttcccatacccctggcttcctaattttaatgtttgctcacagcatagtagattgacatcaaatagtggccgatgatgatgaaaataaaggtcaaataagttgagccaataacagccgcttttttccttctgtctgcgtatacaaagcactgtcatgcacacaatctattctgaccctcacaacaacccataagggtgtaaatagtatttccattttacaaatgaggatcacacaaactactacatggcagagcagatactccaactcatgtcttctggttgaagcctattgctttttcttttctaaacactttccctcagcaagttggaattagacttcacaagtctccttcagagaacacaaatcttttcttattccattcctgtttggttgcctacgtccaatctccccctccccagagatgccaaaaaaaaaatcctttaaggtatttgggagccaaactcaacttgttaaaatctcaaattatggagacaatcagcagacacaacctaaccccaattattttggcaggaaggttggtttagaggcagatccagcaatctgctttgggccactctgggtggggtaggtgaaataagattggtcactgttaactaattttaatattggattggccattggttatcactgattaccattctcccctggattttcacccaggactcaaaacttggttctgctaaccctgttcctttatgaggaaccttttaaagattcctttataaggtgggagttttttttctatgaacctataggggagaaaaaagatcagcagaagtcattacttttttttttttttttttttttttttgagagagagtctcactccattgcccaggctggagtgcagtggtgctatctcggctcactgcaacctccgcctcctgggttcaagcaattctcctgcctcagcctcccgagtagctgggattgcaggtgcccaccaccacacccggctaatttttgtatttttagtaaagacagggtttcaccatgttggccaggctggtctccaactcccaatctcaggtgatcctattgcctcgggctcccaaagtgctgggattacaggagtgagccaccatgcctggccagaagtggttacttctgtagacaaaagaataatgctacttaatcaggctttctgtgtgacaagaaagagaaagaaaataaagaagtttcaattcatccaattcttaataagaaatatgtaaataaaattttttaaaattacacttcattttaatgttgtatcagtcaaggtccctgcaagagatggatggtatggtacactcaaactgggtaacacaggagagttttcagaaagcaactaaatccaaaatactatcaaggaatcaatataaaaattgttaatatttttctcatactaaattttcaaaatattttgtgtctattacatttacagcacatcttaattaggactagctgtgtgttcacctcacatgtggcttgtagctaccatactggacagcacatgtccaaaaaaatacacgtaaagttaaagtttaaaagacacaggaactaagccctcattgtctttcccttgggaggtagtttaaagagctatagatgctgtaacattcttgctattatttattatatatgacattattcctaaaaaagcttttgagatcctaggttgtattcctcaggttttgttgccttcccatgaagatgtgaaggcagggatgcctgttattcagtccaagatgcatgacaagagaccttgggaaagtttcatctggatttaaagattaattcttgatgcttacattccatactcaaaatgtaaatttgaatattaaaataaagatgattttttttttggagctagtcttgctctgttgcccaggctggaatgcagtggcatgatcatggctcactgcagcctcgacctcccaagctcaagcaaggctacaggtgtgcacctaagtagctaggactacaggtgtgcaccaccatgtctagctatttttttttctgtagagacagggttttcctatgttgtccaggctggtctcgaactcctgccctcaagcaatcctcctgccttggcctcccaaagtgttgagattacaggcgtaagccactgcacctggccaagatgaatattttaatagctcacagaacaaagtttgccacataatgataaaattactatgaaaatatattccctttattgtcagtttaaaagatgaactgagtttcacccaaactggtctggcccctctctgattcaaataccaatagttgctctgattcaaattccaactgttagaacatgacagctgctcataactagctttgcttactaaccatgtttctttccatttgtattaggtcctttactttttataacagcctcaaagtttcatgaattgctgcagtaaacattgattttcatgtttgtgagtctgcaagccagctgggcagctctacttcaggtggtaagggtggatcagacctattccatatacctcttgttctccttgtccagtggtttctagggatatgttctcatgatgaaccccgcagaggctcgtgaaagtgagaggaaactaggatgcctcttaaggtcttggtcaggatggggtctcctgtcacttctgtcacaggctattgtaagtcatatgagcaagctcaataaaatataaacaagtcagataaacagtgggaggaatggcaaagtcatatggccaaggccatgagtgattaattttaacacaggaaaaaagtaaagcattaaatgcgattatttaatatacaatgtcttattaactgaaatataaaatgtgtttactgtaaaatataatctgtttatctcaccaaagaaatattatctttaaaaaatgtcattacttctaagacatcatcagtctgcaacttctttccatagccttaatcaggatgctgtggcagctcccacattagcctcgcattctaaactggtagatgtcctaggaaaccatacatctatgtatttttcttattttatacgtttaggacaatgtatagctaattacccaactttttatttgcatacaaatctaatacaactgaacacaatcagttttatcacaggtataatggatttttcaatagtgaggaggtgcctccatgagccttctctttagaaaagtggcattcaagactcttcatttgaagtgaagattgctatgtcttttgcattgctctattttacataaattaagttataaattgacactataatcaactgacaccatgatcagtgatgatgatcaccctcatcagcactagagttgacttgtttttataacccctttgcatgtatgttgaatagcaaagttcatcagagaacatgtattagtcaatggtaagtaagatactctcatctaagaaataacatcacctcttctaatgaagttctaagaagagagggaagaaaaagtcttgggagctagtcagggaatagtgtgtatttgcaattacctaaactgaactctaccattactcctaacccagttcctcctcctgtgttttacatgattaatgccacccctgcctcaatgaaccaagatcagctccatcactgggacctccccattctgcctgtgcaatatttttcttttttatttctccttctaatattactgttattgctccagtaaagagctgtaatatattttacctggactgataccaggaatggtggtgttgcttccaatctgttgctgctagattaatctttgcaaagcacaggcttaatttcattgctgctcaactaaaaccactggtggctttccattgcctacaaaataaagtcaacctccccatcagacattcaaggctttcaatgatccatggccgccagctctctccaggctcatatcccactccactcctctgatgtttcctacactacactacactatactacactacagccaggtagaatgactgttcacccaacaccactcaggttgtcttctcaacttggaatactcttgcaccttcaaagctcatttcaaatgccccttcatttgtgaagccttctccaaatttccaagtcagaatgtctcttccttgtgctaccacaaccctttaactgagcctccattagtgcactgagaccattctgttcagtgtctgggtgaagcttcctggtgaaaaatatgttacctatttctttctgaaaagttggattcagggatattatcacggacctaaggtaatagttctagccaacctccctgtccactgccaggccgactacaaacccttctgttgctggcgagctggtccgcaccactagttctgcttcactctatttatctcttgatgtaaccatcttctttctccaggttttaagaaccagcccaactcctggttccctgatgaagcttttattcccctagccacatggaacttttcctttttggaacatgcctttagtttctgtgtagtttgccatgcagcacttcattgtacacattattaaaacagaattttaaggattagaatgaaccttaaaagatcatgcatctcaaaatttaatgtacatacaaattacccagggattttgttgaaataaaaattatttaattttaattaatataaataattcagtaggtctggggtgaggcctgaggttttacatttccaacaagctgccaggtaaagccaatacatctgtccaggaatcacactttgcgtatcaaaggtctagatgacattatcattccaaagagtttcttttacaggctctcagatcagtgttcatccactacctgactactgtcattcacaggcattctgttccacagcaggccagctaacgtggtatttacaaagctcactcctcttatacaacaatccaagtgtttcttttgtcagttgtctgtgccccaggagatccctctctgccttgccttgccctctgcctttggagaccagcacctcatactcagtgaaggcctggagtgcttaagagggatttcttccagctctcttgccctggtcttcagtgtattagatgtattacctccatgctctcagtagaggcccataggaaagagtaggtaggttatgccagctcacacgcatcctttaaaaatggtttagaagtttagctggtttcttattactcctgtctatggatgtttccttctgtcactctactagggatgaaacagctaatcatgttcaatagttacatttagattggtttttaaaaactatgattgtattagttcgtttccatgctgctgataaagacatatctgagactggaaacaaaaagggtttaattggacttacagttccacatggctggggaggcctcaaaatcaggtgggaggcaaaaggtacttcttacgtggtggcatcaagagcaaaatgaggaagaagcaaaagcagaaactcttcataaacccaccagatcttgtgggacttattatcacgagaatagcacagaaaagactggcctccatgattcaattacctcccactgcgtccctcccacaacatgtgggaattctgggagatacaattcaagttgagatttgggtggggacacagccaaaccatatcattcctccctgggctcctccaaatttcataatcctcacatttcaaaaccaatcattccttcccaacagttccccaaagtcttaactcatttcagcattaacccaaaagtccacagtccaaagtctcatctgagacaaggcaagtcccttccacttacaagcctgtaaaagcaagctagttacctcctagatacaatggggggtacaggtattgggtaaatacagctgttccaaatgagagaaattggccaaaacaaaggggttacagggtccatgcaagtctgaaatccagtggggcagtcaaattttaaagctccataatgatctcctttgactccatgtctcacattcaggtcatgctgatgcaagagataggttcccatggtcttgtgcagctccgcccctgtggctttgcagagtacagcctccctcctggctgctttctcaggctgatgttgagtgtctgtagcttttccaggcacaagatgcaagttggtggttgatctaccattctggggtctaccattctggggtctaccgttctgggactgtggccttcttctcacagctccactaggcagtgccccaacagggactctgtgtgggggctctgccccacatttcccttccacactgccctaggagaggttccccatgagggctctgcccctgcagcaaacttttgcctggacatccaggtgtttccatatatattctgaaatctaggcagaggttcccaaatctcaattcttgacatctctgcacccacaggctcaacatcacatggaagctgccaatgcttggggcctctaccctctgaagccacagcccaagctctatgttggctcctttcagccatggctggagcagctgggacacagggcaccaagtccctaggctgcacacagcacagagaccctgggcccagcccacaaaaccactttttcctcctgggcctctgggcctgtgatgggaggggctgccatgaaggtctctgacatgacctggagacattttccccatggtcttggggattaacattaggctccttgctgcttatgcaaatttctgcagccagcttgaatttctccttaaaaaaaatgggtttttcttttctactgcatcatcaggctgcagattttccacatttatgctcttgtttcccttttaaaacagaatgtttttaacagcacccaagtcaccttttgaatgctttgctgcttagaaatttattccaccagataccctaagtcatctctctcaagctctaagttccacaaatctctagggcaagggtgaaatgctgccagtctccttgctaaaacataacaagggtcacctttacttcagttcccaacaaggtcttcatctccatctgagaccacctcagcctggaccttattgttcatatcactatcagtatttttgtcaatgccattcacagtctctaggaggttccaaactttcctacattttcctatcttcttctgagccctccagattatttcaacacccagttccaaagttgcttccacattttcgggtatcttttcagcaatgccccactctactggtactattagtccattttcatgctgctgataaagacatacctgagactgggaacaaaaagaggtttaattggacttatagttccacctggctggggaggcctcagaatcatggcaggaggtgaaaggcatttcttacacggcagcagcaagagaaaaatgaagaagcagcaaaagcagaaacccctgataaaaccatcagatctcgtgagacttattcactatcacaagaatagcatgggaaagaccagcccccttgattcaattacctccccctgggtcctgtgggaattctggaaggtacaattcaagttgagatttgggtggggacacagccaaaccatatcaatgattttgtactttaaccagctgaatggaagtacaatctcttgctatatgacacaataattatttgcaaaatgagtaaacatatcataaggaaattatttttacaaggtttgaaacctgaaatgcagtctattatcatacataactaaaaatagagcctcaataaacagattcccagttttgaaaatgcaacatttgtactccacattgtcagttttcttaggtatatttataaatactcctataaaaatgtaaagaaacacataatgtagattgctaattttataataacacaagttgattttgacatccaacttattaattatgaaatgacttttggcctagtaacaatgaaaatgggggcaaatacagataaatggtaattcttagaatgaactactcagcaccaattctaagtttttcttgatggtaaatcataatgttccctttctcctcggttctgcaatctataggcataccataattgtaatcaatagcttaaaaatatgtctctctgtcctattctgtatctgtatctcttggatttttacctttgcaatagtcaactgaaccatcttcttggagtactcatgaagatggaagtctacatggagaatacaggatgaatccactctgtctcctgcagtgaagtctgtttgaaggatgtatttggctgtcttctggacaggccattctaataacagaaacaaacaagttattttaaaacttattggaatattcaaatattaaccaaagtagaaaaatataatacacatccatgtgcccatcacagaacttcactgattatcatcatttagccagtcttgaagaagcaagtgctaattacaatcacaaatgaaacaagattcagacttcatgaagagcactgcgctataataaaagaagaaatgagcacatacattcttttactgacagtcaaatggtgaaggtgggcagaatcattatgtgatgcaacatggcaaaagtatacagacagtgcatccagaggaaggcaccttgctgaatgactagaatggaagtaggagacattttgcaggcccccttcatcctgcagggagaaccagaaccacagcagctctatttgcctattcctctttaaattacaaagttaaaatttgggagtagtagaaaatcaattggttatcttatagagtctcctagaatatttcattggcattgagaaggtggaaaatgcaaattatatactttaaaatgtaatttttgcttttcacatatgcttaaagcctaaaacctcttaataaacttcttctgaaatata

SEQ ID NO: 9247 - DNA, 12387 bp, Homo sapiens
cctgttgctctttgctctaatgagccttgagaaaggattgctggtcatgggaccagaggctttatggggagggaagaactgttcttgactttcagtttttcgagcgggtttcaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatataaaaacttaataaagctgtggaaaggaactcttaatcttcttttctgctacttaggttaaattcactagatcttgattaggaatcaaaattcgaattgggacatgttcaaattctttcttgtggtagttgcctatactgtcatcgctgctgttggttgagcatttgtggtgtaccacgctgtgtgctcaagggtattacattcatcttctcatttaatcctcacaacaatctgaagaaggtaggtattacaattcccacttcatagaaacagaaactgaggttcagagaggttaagtcatttgcccaaatggctgagccaaagcctaccatgtacctaacctttattttctttcccgaacataccaggctgtctcctcataacttccaagcatgcacttaaaactccacatgaatacaaggttcatgggacttggtattcatagaaagggaggcagaaagctggtctgttcctgataggcttgtaatttaatatcattctgttcatgtgctttggatggaagcacatctggcatatgatgctaatcagtggttcccatacccctggcttcctaattttaatgtttgctcacagcatagtagattgacatcaaatagtggccgatgatgatgaaaataaaggtcaaataagttgagccaataacagccgcttttttccttctgtctgcgtatacaaagcactgtcatgcacacaatctattctgaccctcacaacaacccataagggtgtaaatagtatttccattttacaaatgaggatcacacaaactactacatggcagagcagatactccaactcatgtcttctggttgaagcctattgctttttcttttctaaacactttccctcagcaagttggaattagacttcacaagtctccttcagagaacacaaatcttttcttattccattcctgtttggttgcctacgtccaatctccccctccccagagatgccaaaaaaaaaatcctttaaggtatttgggagccaaactcaacttgttaaaatctcaaattatggagacaatcagcagacacaacctaaccccaattattttggcaggaaggttggtttagaggcagatccagcaatctgctttgggccactctgggtggggtaggtgaaataagattggtcactgttaactaattttaatattggattggccattggttatcactgattaccattctcccctggattttcacccaggactcaaaacttggttctgctaaccctgttcctttatgaggaaccttttaaagattcctttataaggtgggagttttttttctatgaacctataggggagaaaaaagatcagcagaagtcattacttttttttttttttttttttttttttgagagagagtctcactccattgcccaggctggagtgcagtggtgctatctcggctcactgcaacctccgcctcctgggttcaagcaattctcctgcctcagcctcccgagtagctgggattgcaggtgcccaccaccacacccggctaatttttgtatttttagtaaagacagggtttcaccatgttggccaggctggtctccaactcccaatctcaggtgatcctattgcctcgggctcccaaagtgctgggattacaggagtgagccaccatgcctggccagaagtggttacttctgtagacaaaagaataatgctacttaatcaggctttctgtgtgacaagaaagagaaagaaaataaagaagtttcaattcatccaattcttaataagaaatatgtaaataaaattttttaaaattacacttcattttaatgttgtatcagtcaaggtccctgcaagagatggatggtatggtacactcaaactgggtaacacaggagagttttcagaaagcaactaaatccaaaatactatcaaggaatcaatataaaaattgttaatatttttctcatactaaattttcaaaatattttgtgtctattacatttacagcacatcttaattaggactagctgtgtgttcacctcacatgtggcttgtagctaccatactggacagcacatgtccaaaaaaatacacgtaaagttaaagtttaaaagacacaggaactaagccctcattgtctttcccttgggaggtagtttaaagagctatagatgctgtaacattcttgctattatttattatatatgacattattcctaaaaaagcttttgagatcctaggttgtattcctcaggttttgttgccttcccatgaagatgtgaaggcagggatgcctgttattcagtccaagatgcatgacaagagaccttgggaaagtttcatctggatttaaagattaattcttgatgcttacattccatactcaaaatgtaaatttgaatattaaaataaagatgattttttttttggagctagtcttgctctgttgcccaggctggaatgcagtggcatgatcatggctcactgcagcctcgacctcccaagctcaagcaaggctacaggtgtgcacctaagtagctaggactacaggtgtgcaccaccatgtctagctatttttttttctgtagagacagggttttcctatgttgtccaggctggtctcgaactcctgccctcaagcaatcctcctgccttggcctcccaaagtgttgagattacaggcgtaagccactgcacctggccaagatgaatattttaatagctcacagaacaaagtttgccacataatgataaaattactatgaaaatatattccctttattgtcagtttaaaagatgaactgagtttcacccaaactggtctggcccctctctgattcaaataccaatagttgctctgattcaaattccaactgttagaacatgacagctgctcataactagctttgcttactaaccatgtttctttccatttgtattaggtcctttactttttataacagcctcaaagtttcatgaattgctgcagtaaacattgattttcatgtttgtgagtctgcaagccagctgggcagctctacttcaggtggtaagggtggatcagacctattccatatacctcttgttctccttgtccagtggtttctagggatatgttctcatgatgaaccccgcagaggctcgtgaaagtgagaggaaactaggatgcctcttaaggtcttggtcaggatggggtctcctgtcacttctgtcacaggctattgtaagtcatatgagcaagctcaataaaatataaacaagtcagataaacagtgggaggaatggcaaagtcatatggccaaggccatgagtgattaattttaacacaggaaaaaagtaaagcattaaatgcgattatttaatatacaatgtcttattaactgaaatataaaatgtgtttactgtaaaatataatctgtttatctcaccaaagaaatattatctttaaaaaatgtcattacttctaagacatcatcagtctgcaacttctttccatagccttaatcaggatgctgtggcagctcccacattagcctcgcattctaaactggtagatgtcctaggaaaccatacatctatgtatttttcttattttatacgtttaggacaatgtatagctaattacccaactttttatttgcatacaaatctaatacaactgaacacaatcagttttatcacaggtataatggatttttcaatagtgaggaggtgcctccatgagccttctctttagaaaagtggcattcaagactcttcatttgaagtgaagattgctatgtcttttgcattgctctattttacataaattaagttataaattgacactataatcaactgacaccatgatcagtgatgatgatcaccctcatcagcactagagttgacttgtttttataacccctttgcatgtatgttgaatagcaaagttcatcagagaacatgtattagtcaatggtaagtaagatactctcatctaagaaataacatcacctcttctaatgaagttctaagaagagagggaagaaaaagtcttgggagctagtcagggaatagtgtgtatttgcaattacctaaactgaactctaccattactcctaacccagttcctcctcctgtgttttacatgattaatgccacccctgcctcaatgaaccaagatcagctccatcactgggacctccccattctgcctgtgcaatatttttcttttttatttctccttctaatattactgttattgctccagtaaagagctgtaatatattttacctggactgataccaggaatggtggtgttgcttccaatctgttgctgctagattaatctttgcaaagcacaggcttaatttcattgctgctcaactaaaaccactggtggctttccattgcctacaaaataaagtcaacctccccatcagacattcaaggctttcaatgatccatggccgccagctctctccaggctcatatcccactccactcctctgatgtttcctacactacactacactatactacactacagccaggtagaatgactgttcacccaacaccactcaggttgtcttctcaacttggaatactcttgcaccttcaaagctcatttcaaatgccccttcatttgtgaagccttctccaaatttccaagtcagaatgtctcttccttgtgctaccacaaccctttaactgagcctccattagtgcactgagaccattctgttcagtgtctgggtgaagcttcctggtgaaaaatatgttacctatttctttctgaaaagttggattcagggatattatcacggacctaaggtaatagttctagccaacctccctgtccactgccaggccgactacaaacccttctgttgctggcgagctggtccgcaccactagttctgcttcactctatttatctcttgatgtaaccatcttctttctccaggttttaagaaccagcccaactcctggttccctgatgaagcttttattcccctagccacatggaacttttcctttttggaacatgcctttagtttctgtgtagtttgccatgcagcacttcattgtacacattattaaaacagaattttaaggattagaatgaaccttaaaagatcatgcatctcaaaatttaatgtacatacaaattacccagggattttgttgaaataaaaattatttaattttaattaatataaataattcagtaggtctggggtgaggcctgaggttttacatttccaacaagctgccaggtaaagccaatacatctgtccaggaatcacactttgcgtatcaaaggtctagatgacattatcattccaaagagtttcttttacaggctctcagatcagtgttcatccactacctgactactgtcattcacaggcattctgttccacagcaggccagctaacgtggtatttacaaagctcactcctcttatacaacaatccaagtgtttcttttgtcagttgtctgtgccccaggagatccctctctgccttgccttgccctctgcctttggagaccagcacctcatactcagtgaaggcctggagtgcttaagagggatttcttccagctctcttgccctggtcttcagtgtattagatgtattacctccatgctctcagtagaggcccataggaaagagtaggtaggttatgccagctcacacgcatcctttaaaaatggtttagaagtttagctggtttcttattactcctgtctatggatgtttccttctgtcactctactagggatgaaacagctaatcatgttcaatagttacatttagattggtttttaaaaactatgattgtattagttcgtttccatgctgctgataaagacatatctgagactggaaacaaaaagggtttaattggacttacagttccacatggctggggaggcctcaaaatcaggtgggaggcaaaaggtacttcttacgtggtggcatcaagagcaaaatgaggaagaagcaaaagcagaaactcttcataaacccaccagatcttgtgggacttattatcacgagaatagcacagaaaagactggcctccatgattcaattacctcccactgcgtccctcccacaacatgtgggaattctgggagatacaattcaagttgagatttgggtggggacacagccaaaccatatcattcctccctgggctcctccaaatttcataatcctcacatttcaaaaccaatcattccttcccaacagttccccaaagtcttaactcatttcagcattaacccaaaagtccacagtccaaagtctcatctgagacaaggcaagtcccttccacttacaagcctgtaaaagcaagctagttacctcctagatacaatggggggtacaggtattgggtaaatacagctgttccaaatgagagaaattggccaaaacaaaggggttacagggtccatgcaagtctgaaatccagtggggcagtcaaattttaaagctccataatgatctcctttgactccatgtctcacattcaggtcatgctgatgcaagagataggttcccatggtcttgtgcagctccgcccctgtggctttgcagagtacagcctccctcctggctgctttctcaggctgatgttgagtgtctgtagcttttccaggcacaagatgcaagttggtggttgatctaccattctggggtctaccattctggggtctaccgttctgggactgtggccttcttctcacagctccactaggcagtgccccaacagggactctgtgtgggggctctgccccacatttcccttccacactgccctaggagaggttccccatgagggctctgcccctgcagcaaacttttgcctggacatccaggtgtttccatatatattctgaaatctaggcagaggttcccaaatctcaattcttgacatctctgcacccacaggctcaacatcacatggaagctgccaatgcttggggcctctaccctctgaagccacagcccaagctctatgttggctcctttcagccatggctggagcagctgggacacagggcaccaagtccctaggctgcacacagcacagagaccctgggcccagcccacaaaaccactttttcctcctgggcctctgggcctgtgatgggaggggctgccatgaaggtctctgacatgacctggagacattttccccatggtcttggggattaacattaggctccttgctgcttatgcaaatttctgcagccagcttgaatttctccttaaaaaaaatgggtttttcttttctactgcatcatcaggctgcagattttccacatttatgctcttgtttcccttttaaaacagaatgtttttaacagcacccaagtcaccttttgaatgctttgctgcttagaaatttattccaccagataccctaagtcatctctctcaagctctaagttccacaaatctctagggcaagggtgaaatgctgccagtctccttgctaaaacataacaagggtcacctttacttcagttcccaacaaggtcttcatctccatctgagaccacctcagcctggaccttattgttcatatcactatcagtatttttgtcaatgccattcacagtctctaggaggttccaaactttcctacattttcctatcttcttctgagccctccagattatttcaacacccagttccaaagttgcttccacattttcgggtatcttttcagcaatgccccactctactggtactattagtccattttcatgctgctgataaagacatacctgagactgggaacaaaaagaggtttaattggacttatagttccacctggctggggaggcctcagaatcatggcaggaggtgaaaggcatttcttacacggcagcagcaagagaaaaatgaagaagcagcaaaagcagaaacccctgataaaaccatcagatctcgtgagacttattcactatcacaagaatagcatgggaaagaccagcccccttgattcaattacctccccctgggtcctgtgggaattctggaaggtacaattcaagttgagatttgggtggggacacagccaaaccatatcaatgattttgtactttaaccagctgaatggaagtacaatctcttgctatatgacacaataattatttgcaaaatgagtaaacatatcataaggaaattatttttacaaggtttgaaacctgaaatgcagtctattatcatacataactaaaaatagagcctcaataaacagattcccagttttgaaaatgcaacatttgtactccacattgtcagttttcttaggtatatttataaatactcctataaaaatgtaaagaaacacataatgtagattgctaattttataataacacaagttgattttgacatccaacttattaattatgaaatgacttttggcctagtaacaatgaaaatgggggcaaatacagataaatggtaattcttagaatgaactactcagcaccaattctaagtttttcttgatggtaaatcataatgttccctttctcctcggttctgcaatctataggcataccataattgtaatcaatagcttaaaaatatgtctctctgtcctattctgtatctgtatctcttggatttttacctttgcaatagtcaactgaaccatcttcttggagtactcatgaagatggaagtctacatggagaatacaggatgaatccactctgtctcctgcagtgaagtctgtttgaaggatgtatttggctgtcttctggacaggccattctaataacagaaacaaacaagttattttaaaacttattggaatattcaaatattaaccaaagtagaaaaatataatacacatccatgtgcccatcacagaacttcactgattatcatcatttagccagtcttgaagaagcaagtgctaattacaatcacaaatgaaacaagattcagacttcatgaagagcactgcgctataataaaagaagaaatgagcacatacattcttttactgacagtcaaatggtgaaggtgggcagaatcattatgtgatgcaacatggcaaaagtatacagacagtgcatccagaggaaggcaccttgctgaatgactagaatggaagtaggagacattttgcaggcccccttcatcctgcagggagaaccagaaccacagcagctctatttgcctattcctctttaaattacaaagttaaaatttgggagtagtagaaaatcaattggttatcttatagagtctcctagaatatttcattggcattgagaaggtggaaaatgcaaattatatactttaaaatgtaatttttgcttttcacatatgcttaaagcctaaaacctcttaataaacttcttctgaaatata

SEQ ID NO: 9248 - DNA, 1500 bp, Homo sapiens
ctcccgcgcgcccgcccgcccatggccgggaaggtgcggtcactgctgccgccgctgctgctggccgccgcgggcctcgccggcctcctactgctgtgcgtccccacccgcgacgtccgggagccgcccgccctcaagtatggcatcgtcctggacgctggttcttcacacacgtccatgtttatctacaagtggccggcagacaaggagaacgacacaggcattgtgggccagcacagctcctgtgatgttccaggtgggggcatctccagctatgcagacaacccttctggggccagccagagtcttgttggatgcctcgaacaggcgcttcaggatgtgcccaaagagagacacgcgggcacacccctctacctgggagccacagcgggtatgcgcctgctcaacctgaccaatccagaggcctcgaccagtgtgctcatggcagtgactcacacactgacccagtacccctttgacttccggggtgcacgcatcctctcgggccaggaagagggggtgtttggctgggtgactgccaactacctgctggagaacttcatcaagtacggctgggtgggccggtggttccggccacggaaggggacactgggggccatggacctggggggtgcctctacccagatcacttttgagacaaccagtccagctgaggacagagccagcgaggtccagctgcatctctacggccagcactaccgagtctacacccacagcttcctctgctatggccgtgaccaggtcctccagaggctgctggccagcgccctccagacccacggcttccacccctgctggccgaggggcttttccacccaagtgctgctcggggatgtgtaccagtcaccatgcaccatggcccagcggccccagaacttcaacagcagtgccagggtcagcctgtcagggagcagtgacccccacctctgccgagatctggtttctgggctcttcagcttctcctcctgccccttctcccgatgctctttcaatggggtcttccagcccccagtggctgggaactttgtggccttctctgccttcttctacactgtggactttttgcggacttcgatggggctgcccgtggccaccctgcagcagctggaggcagccgcagtgaatgtctgcaaccagacctgggctcagcagctgctgagtcgcggctacggcttcgacgagcgcgccttcggcggcgtgatcttccagaagaaggccgcggacactgcagtgggctgggcgctcggctacatgctgaacctgaccaacctgatccccgccgacccgccggggctgcgcaagggcacagacttcagctcctgggtcgtcctcctgctgctcttcgcctccgcgctcctggctgcgcttgtcctgctgctgcgtcaggtgcactccgccaagctgccaagcaccatttaggggccgacgggggcagctgccccatccctcccccaacccctgtatccccaccccgtactc

SEQ ID NO: 9249 - DNA, 2095 bp, Homo sapiens
ccgcactctccgggtccacgcatcgtcctcccgcgcgcccgcccgcccatggccgggaaggtgcggtcactgctgccgccgctgctgctggccgccgcgggcctcgccggcctcctactgctgtgcgtccccacccgcgacgtccgggagccgcccgccctcaagtatggcatcgtcctggacgctggttcttcacacacgtccatgtttatctacaagtggccggcagacaaggagaacgacacaggcattgtgggccagcacagctcctgtgatgttccaggtgggggcatctccagctatgcagacaacccttctggggccagccagagtcttgttggatgcctcgaacaggcgcttcaggatgtgcccaaagagagacacgcgggcacacccctctacctgggagccacagcgggtatgcgcctgctcaacctgaccaatccagaggcctcgaccagtgtgctcatggcagtgactcacacactgacccagtacccctttgacttccggggtgcacgcatcctctcgggccaggaagagggggtgtttggctgggtgactgccaactacctgctggagaacttcatcaagtacggctgggtgggccggtggttccggccacggaaggggacactgggggccatggacctggggggtgcctctacccagatcacttttgagacaaccagtccagctgaggacagagccagcgaggtccagctgcatctctacggccagcactaccgagtctacacccacagcttcctctgctatggccgtgaccaggtcctccagaggctgctggccagcgccctccagacccacggcttccacccctgctggccgaggggcttttccacccaagtgctgctcggggatgtgtaccagtcaccatgcaccatggcccagcggccccagaacttcaacagcagtgccagggtcagcctgtcagggagcagtgacccccacctctgccgagatctggtttctgggctcttcagcttctcctcctgccccttctcccgatgctctttcaatggggtcttccagcccccagtggctgggaactttgtggccttctctgccttcttctacactgtggactttttgcggacttcgatggggctgcccgtggccaccctgcagcagctggaggcagccgcagtgaatgtctgcaaccagacctgggctcagctgcaagctcgggtgccagggcaacgggcccgcctggccgactactgcgccggggccatgttcgtgcagcagctgctgagtcgcggctacggcttcgacgagcgcgccttcggcggcgtgatcttccagaagaaggccgcggacactgcagtgggctgggcgctcggctacatgctgaacctgaccaacctgatccccgccgacccgccggggctgcgcaagggcacagacttcagctcctgggtcgtcctcctgctgctcttcgcctccgcgctcctggctgcgcttgtcctgctgctgcgtcaggtgcactccgccaagctgccaagcaccatttaggggccgacgggggcagctgccccatccctcccccaacccctgtatccccaccccgtactcccacccctcccacaacccctgtacctcccacccctgtatccccacccctccacccacccctctcccaacctctctccccgcccctgtatcctgcattcctccacccaccctctatcccccaccgctccaccccaccactgtcttctccatccttccaccccaccctcagcgtctctgcccctaaggcagcccaggaaataggaactgagactctggtacccacaggagcctgggtgggcaaagagcgctcaatccagctccttgaacccctccagcccgcttcagcctgggcatcactgcaggccccgtgctcctcctcctcctcctcagggctgggtctccagagagtggggccttggtcctgagaatcagcccttagaggctccttctgtgtagtctgggtctgtactggggagggtcacagcccacgggctggcagccagcccagcacctacttgtaaaaattttgtaataaaaagtttttcctagagacgtgaaa

SEQ ID NO: 9250 - DNA, 2819 bp, Homo sapiens
atacccggcgccgcctcccggcgtctgagctgacacctccttagcgctggccgcgggccgcctctgcggcagcgctagtcgccttctccgaatcggctccgcacagctaggagaaaagatgttcactgtgctgacccgccaaccatgtgagcaagcaggcctcaaggccctctaccgaactccaaccatcattgccttggtggtcttgcttgtgagtattgtggtacttgtgagtatcactgtcatccagatccacaagcaagaggtcctccctccaggactgaagtatggtattgtgctggatgccgggtcttcaagaaccacagtctacgtgtatcaatggccagcagaaaaagagaataataccggagtggtcagtcaaaccttcaaatgtagtgtgaaaggctctggaatctccagctatggaaataacccccaagatgtccccagagcctttgaggagtgtatgcaaaaagtcaaggggcaggttccatcccacctccacggatccacccccattcacctgggagccacggctgggatgcgcttgctgaggttgcaaaatgaaacagcagctaatgaagtccttgaaagcatccaaagctacttcaagtcccagccctttgactttaggggtgctcaaatcatttctgggcaagaagaaggggtatatggatggattacagccaactatttaatgggaaatttcctggagaagaacctgtggcacatgtgggtgcacccgcatggagtggaaaccacgggtgccctggacttaggtggtgcctccacccaaatatccttcgtggcaggagagaagatggatctgaacaccagcgacatcatgcaggtgtccctgtatggctacgtatacacgctctacacacacagcttccagtgctatggccggaatgaggctgagaagaagtttctggcaatgctcctgcagaattctcctaccaaaaaccatctcaccaatccctgttaccctcgggattatagcatcagcttcaccatgggccatgtatttgatagcctgtgcactgtggaccagaggccagaaagttataaccccaatgatgtcatcacttttgaaggaactggggacccatctctgtgtaaggagaaggtggcttccatatttgacttcaaagcttgccatgatcaagaaacctgttcttttgatggggtttatcagccaaagattaaagggccatttgtggcttttgcaggattctactacacagccagtgctttaaatctttcaggtagcttttccctggacaccttcaactccagcacctggaatttctgctcacagaattggagtcagctcccactgctgctccccaaatttgatgaggtatatgcccgctcttactgcttctcagccaactacatctaccacttgtttgtgaacggttacaaattcacagaggagacttggccccaaatacactttgaaaaagaagtggggaatagcagcatagcctggtctcttggctacatgctcagcctgaccaaccagatcccagctgaaagccctctgatccgtctgcccatagaaccacctgtctttgtgggcaccctcgctttcttcacagcggcagccttgctgtgtctggcatttcttgcatacctgtgttcagcaaccagaagaaagaggcactccgagcatgcctttgaccatgcagtggattctgactgagccttcaaagcagctcctggagtccaatggctgcttagagtcagcctgggtggcaccaggcaatgcaggtgaagtggctgccttcaggaaatacaactaactaaaatcaaacacctaggtcacgtgcctctcaaatactgatttctgccacagcacctcttgaggcatcccttggctattctgtgcatattgttcttcagagacctcactacccacatgctgatctattggggaacagagaagagacaggccacgaaggtcaggctctttatattaagttccccagaggaagagtaagttgagaaggtatcagtttaatgttgaagaattgacctcagggctcagtttccatttccctccctcagtattcttcctggcaagatacccattaagcatttcgccaatcagaatctcattttatagtttttcccattggtctttaactaagactttcttgtagcaatctcgtaagcagtgaaccccctcagatcagtagaatatagtatctgggggagaagacttacttccttcagggcagcagccacagccaggcttctgtcatacaggtagatcccgaagcacagagacataaaaaaggtctcccagaaaactatagaccattctccaagtggaattcccacttagggctctggtcactagattgcaacctgtgtgtttgtcatcatcctcatctcaccattgtattgctatgccctcccataaaaacacattgatccctagcaagattattgcattccagattttactgcctttgctaggcttttgcttagcaaagggctgactttccattgttatcatggtgtatatatttttgtcaccattcccacaagtatacttgatgttgtcatagaacgaacatcctactctatgatttactaaccaattactttcccagatcatagacctctctgcatagtagtcataggtcttgactttggggaaagaaaaggaagctgcaggaatatttatctccaaagtcgaatgagaaagaactccagcaaatccaatggctacaaactaaaaatcagcattatttcatattgctgtttcttagctgaatatggaataaagaactattattttattttga

SEQ ID NO: 9251 - DNA, 1749 bp, Homo sapiens
gaatcggctccgcacaggtaagatcaggggacccggcgcctgagctgccgaggaaggagtcgggggtgctgcgtgagactgagagttgggaggcaaagaaacaaaatcggatttcctcagagggccagaggaagagactgaaacacgctaggagaaaagatgttcactgtgctgacccgccaaccatgtgagcaagcaggcctcaaggccctctaccgaactccaaccatcattgccttggtggtcttgcttgtgagtattgtggtacttgtgagtatcactgtcatccagatccacaagcaagaggtcctccctccaggactgaagtatggtattgtgctggatgccgggtcttcaagaaccacagtctacgtgtatcaatggccagcagaaaaagagaataataccggagtggtcagtcaaaccttcaaatgtagtgtgaaaggctctggaatctccagctatggaaataacccccaagatgtccccagagcctttgaggagtgtatgcaaaaagtcaaggggcaggttccatcccacctccacggatccacccccattcacctgggagccacggctgggatgcgcttgctgaggttgcaaaatgaaacagcagctaatgaagtccttgaaagcatccaaagctacttcaagtcccagccctttgactttaggggtgctcaaatcatttctgggcaagaagaaggggtatatggatggattacagccaactatttaatgggaaatttcctggagaagaacctgtggcacatgtgggtgcacccgcatggagtggaaaccacgggtgccctggacttaggtggtgcctccacccaaatatccttcgtggcaggagagaagatggatctgaacaccagcgacatcatgcaggtgtccctgtatggctacgtatacacgctctacacacacagcttccagtgctatggccggaatgaggctgagaagaagtttctggcaatgctcctgcagaattctcctaccaaaaaccatctcaccaatccctgttaccctcgggattatagcatcagcttcaccatgggccatgtatttgatagcctgtgcactgtggaccagaggccagaaagttataaccccaatgatgtcatcacttttgaaggaactggggacccatctctgtgtaaggagaaggtggcttccatatttgacttcaaagcttgccatgatcaagaaacctgttcttttgatggggtttatcagccaaagattaaagggccatttgtggcttttgcaggattctactacacagccagtgctttaaatctttcaggtagcttttccctggacaccttcaactccagcacctggaatttctgctcacagaattggagtcagctcccactgctgctccccaaatttgatgaggtatatgcccgctcttactgcttctcagccaactacatctaccacttgtttgtgaacggttacaaattcacagaggagacttggccccaaatacactttgaaaaagaagtggggaatagcagcatagcctggtctcttggctacatgctcagcctgaccaaccagatcccagctgaaagccctctgatccgtctgcccatagaaccacctgtctttgtgggcaccctcgctttcttcacagcggcagccttgctgtgtctggcatttcttgcatacctgtgttcagcaaccagaagaaagaggcactccgagcatgcctttgaccatgcagtggattctgactga

SEQ ID NO: 9252 - DNA, 5842 bp, Homo sapiens
tagcccaggcgccgcggcgcgcggggtggggcggaggtcgcgccgagggcggcgggctgccgcgcaagggtggcgcgcgcgcgttttccttgttcctggtcaacaaagaaatgtggagtgtcttggctgaatcctcatacagacaagatcattatggtgctgttaggtaggacttgtatccagatgtaaggttgaaaaagtgatataataaaggaaccaaggagaaaattcagaaggaaagaaaaaattgcctctgcaggtgtgcgagcaggattgcttctgcaacaaaagcctccacccagccacatcttgggaaaagaatggccacttcttggggcacagtctttttcatgctggtggtatcctgtgtttgcagcgctgtctcccacaggaaccagcagacttggtttgagggtatcttcctgtcttccatgtgccccatcaatgtcagcgccagcaccttgtatggaattatgtttgatgcagggagcactggaactcgaattcatgtttacacctttgtgcagaaaatgccaggacagcttccaattctagaaggggaagtttttgattctgtgaagccaggactttctgcttttgtagatcaacctaagcagggtgctgagaccgttcaagggctcttagaggtggccaaagactcaatcccccgaagtcactggaaaaagaccccagtggtcctaaaggcaacagcaggactacgcttactgccagaacacaaagccaaggctctgctctttgaggtaaaggagatcttcaggaagtcacctttcctggtaccaaagggcagtgttagcatcatggatggatccgacgaaggcatattagcttgggttactgtgaattttctgacaggtcagctgcatggccacagacaggagactgtggggaccttggacctagggggagcctccacccaaatcacgttcctgccccagtttgagaaaactctggaacaaactcctaggggctacctcacttcctttgagatgtttaacagcacttataagctctatacacatagttacctgggatttggattgaaagctgcaagactagcaaccctgggagccctggagacagaagggactgatgggcacactttccggagtgcctgtttaccgagatggttggaagcagagtggatctttgggggtgtgaaataccagtatggtggcaaccaagaaggggaggtgggctttgagccctgctatgccgaagtgctgagggtggtacgaggaaaacttcaccagccagaggaggtccagagaggttccttctatgctttctcttactattatgaccgagctgttgacacagacatgattgattatgaaaaggggggtattttaaaagttgaagattttgaaagaaaagccagggaagtgtgtgataacttggaaaacttcacctcaggcagtcctttcctgtgcatggatctcagctacatcacagccctgttaaaggatggctttggctttgcagacagcacagtcttacagctcacaaagaaagtgaacaacatagagacgggctgggccttgggggccacctttcacctgttgcagtctctgggcatctcccattgaggccacgtacttccttggagacctgcatttgccaacacctttttaaggggaggagagagcacttagtttctgaactagtctggggacatcctggacttgagcctagagatttaggtttaattaattttacacatctaatgtgaactgctgcctaaccactcaagagtacacagctggcaccagagcatcacagagagccctgtgagccaaaaagtatagttttggaacttaaccttggagtgagagcccagggacaggtccctggaaaccaaagaaaaatcgcatttcaaccctttgagtgcctcattccactgaatatttaaattttcctcttaaatggtaaactgacttattgcaatcccaagacccatcaatatcagtatttttttcctccctatacagtgccctgcccacccttatctgcacccacctcccctgaaaaagagagaaaaaaaaaaacctggttttgctttccatgtataattcaacaacgcaaaatgggaccatgtcagaatctgtatgatcctattctgtgttagctccaatcagccagctgagagccatcctaaatattaataggatgagagagtaactcctaactgtgcataaattacagccttaagaaagaaggccacccggtctctggggacatgttttgggagggtgtggctgcctcatatagcctacctttgctttaatcagcattttatcagtcaactctgggattaatgaacatatccgactttatgggtatgtgtatattcagtgccagtaccacctcccaggctaatgtgttaacagtgttttctatgattctaaacttgttttctttgtatttctaagaaatacaactaggccctaacttttggtctgtggtcagaggtcagtgtctgtgctattccaggatctattatttcagtttgcccttttattctctccgtttgtaacagtaccttcctgtcctggtccctgatcactttagctaatatcctttgaattatttatctagttcagagtttccaataccgttcctgacaaaaccccacttggatttggttggctctctcagcccacatcagtacagtggaccaacatttccagggagaaccatatttaatgtccctcatgctctctttttgaatccaagtgctcagagctcttgactgtgaattatttaccccaaattcattatcttgcacttttttttgagatggagtcttgctctgttgctcaggctagagtggagtggcgcaatctcagctcactgcaacctccgcccccaggttcaagcgattcttgttctcagcctcctgaagagctgggattacaggtgcccaccaccattcctggctaatttttgtatttgtagtagagatggggtttcaccatgttggccaggctggtttccaactcctgatctcaattgatccacccgcttcccaaagtgctgggattacaggcatgagacaccgcgcctggccttatcttgcactttcaacataatcatccctgcttctcatctgccctgcagtgctcttggacctggaagatctccctgtggtctggcccctttgccttggttgttaacctccagcttctttgcaggagtgtatttccccaaaacttgtggctttcacagtagactccgtttccatcctctctctcacaaaggatgttaagtatgcctggccctcacacagtccatgggaaaccttatttttaacattactccattgagtcaataaatatttaccatctgctgtgtgcaagttactaggcaaatttctgtatccttgtccctaaaattcttgtctttaaattcattgtggaatttctttagacttcacactgacttttattactaaggtcacctttataccaactgccttcctcaaaatgcttataatgaaataacagaatcttgagttggaaacagcccaaagaaataatccaatgttgtactcagtgcagaattccctagaatttctaacaggttgtcattcagcttctgctaagccatgttcaaacagcttattccatttggaactgcactgatattaaaaaaaattccttatattgagctgaaatctacctatcttctaagtggtcttagttctgctctaatctctccttccaaaatctttggatcttttgaaaaaagttcctcccaagttcttttataagtgacatgacttttagaccccttcccatctttgtcaacaaaagtagggtgccagaccagtcacagaacactaaatgtcatccatgtttccttcagtagaaaccagcagttttaaaagaggtaagctgtgttcactaaagactgttccagcttgacaaatgcagagatataagtctctggtctttaatcactgtgggggccattttgtaaaacacacatactgtccagcagactcctttggtcatcccaaatacctctgaactccagggaagatgcattctaactccacgaacttacctattttgttaaccttgattagaccttctggagaagtaaccaatttgtccatcttaggagcaatttggaatgagagtttttatttttttctgtaacgcccatcctgcctgcagtagaccctttgggcttaagaggtcctacagattctaatagtttcctctttgtagatgtgttaacatatttaaaatacttaggacatggcctggtacgtgacagatggtgtttaacatcattgtcatatgaagaacactctctgtgggccaatggaggtgtgccttaaaattcttcatcttgcctgattttgtttgcataacttctggagagtctgtgtcctcctcatctaggccacctttccattttttgtgaaagatgaccttgtccctgcagtctccgccaggagtcacacagcttttcacagcagctgccatctttaattctttttcctgagattccagcaaggttgtgacattgtcacttttttgttctagactcttttaaattttctgcatttgcctgaaaagcacccctgtaagaatagatttctcatggctctaaaaattattcccaagaataccttacttggttcaaaagcagactgtttctcttcatttcatctcaaatcagacttctgggcaagatgttctttagagtaagcaaacctacaacctaaaaatctcttcaagaggcatctctggtcttgtgacgagacctcttcaaaaacccacagtaaaactcccctccctccagttggccaccagtctgccaccaaacatgaacaaattctgctgctaatcggtttcccttgtgatctggttcctgaggtcttcggatctgtgcaatgaattatttattgttttattaaaccgacagtggtgtcccagagaggaaccataaataaaatggaaatctggtgctgtgataaagtaataactagcattaatgagacctggttttcctttcagaaagtccagtatacctgtaacaaaggttaaagcaatttatatttaatttgcattctgatgttaacatttaaacagcaattctaacaaaaatgcatcgagtctaattcttacctctatcaaaaaacaactgtataaatttatgaccaacattaaaacaaaaacaaaatgtaaattttctctttagaaatgattaactggaaatgagtgagacagcaccttgtgggttttttagtaataaaaagctcttttcaaccaaattgtaagtcttccttcgaagttttttcctttggtctggctaatatacgctcctcacagcaaattatcattcattatttgggtgccacaggcccattaagcaaagaagaaaaagagaattttaatgtaaagtaagtttattaaattaaataagatcttgaaaatatgtatgatgggtcctgggcaggatgttctttttcatcaacgtaatctttctttaggagaggagtactcatttgcttgcaaaggccataatctgttcctggagaaaaaataaaagtgaatgaaactcttaacacagtaaggtgaagaaaataattattgtagataataatcacgtaggtattcttcccaagtgtccttgttttatttcagctaaaaaaagaaaaatatacatacatatacacacgttttagagacagggtctcactctgttgactgggctggagtgcagtggtgtgatcatagctcactgcagcctcaaactcctaggctcaagcaatcctccctccccagcctcctataaagtgctgggatta

SEQ ID NO: 9253 - DNA, 2708 bp, Homo sapiens
gtgacgccacgtgcatggggcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatgcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcaagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacaggggcttctccttctctgg

SEQ ID NO: 9254 - DNA, 2766 bp, Homo sapiens
acgtgcatggggcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcaagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacaggggcttctccttctctgg

SEQ ID NO: 9255 - DNA, 2805 bp, Homo sapiens
gtgcatggggcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacggtgggagtcacctggagcgtgaagggacgtgtctcatccccagtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcaagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacaggggcttctccttc

SEQ ID NO: 9256 - DNA, 2750 bp, Homo sapiens
caggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcaagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacaggggcttctccttctctgg

SEQ ID NO: 9257 - DNA, 2100 bp, Homo sapiens
ggtcctcaaggccacagctggcttacgcctgttacctggagaaaaggcccagaagttactgcagaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacggtgggagtcacctggagcgtgaagggacgtgtctcatccccagtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcaagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacaggggcttctccttctctgg

SEQ ID NO: 9258 - DNA, 809 bp, Homo sapiens
gtggggtcgtatcccgcgggtggaggccggggtggcgccggccggggcgggggagcccaaaagaccggctgccgcctgctccccggaaaagggcactcgtctccgtgggtgtggcggagcgcgcggtgcatgccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacag

SEQ ID NO: 9259 - DNA, 656 bp, Homo sapiens
caaaagaccggctgccgcctgctccccggaaaagggcactcgtctccgtgggtgtggcggagcgcgcggtgcatgcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgc

SEQ ID NO: 9260 - DNA, 945 bp, Homo sapiens
cgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcag

SEQ ID NO: 9261 - DNA, 451 bp, Homo sapiens
ggccggggcgggggagcccaaaagaccggctgccgcctgctccccggaaaagggcactcgtctccgtgggtgtggcggagcgcgcggtgcatgaaactcccacgttaacccacgaaaccttcaaagcactgaagccaggtctttctgcctatgctgatgatgttgaaaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacag

SEQ ID NO: 9262 - DNA, 2654 bp, Homo sapiens
ggaggccggggtggcgccggccggggcgggggagcccaaaagaccggctgccgcctgctccccggaaaagggcactcgtctccgtgggtgtggcggagcgcgcggtgcatggaatgggctatgtgaatgaaaaaaggtatccgttatgaaacttccagaaaaacgagctacatttttcagcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacggtgggagtcacctggagcgtgaagggacgtgtctcatccccagtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcaagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacaggggcttctccttctctgg

SEQ ID NO: 9263 - DNA, 940 bp, Homo sapiens
ggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatgaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtggg

SEQ ID NO: 9264 - DNA, 878 bp, Homo sapiens
ccaaaagaccggctgccgcctgctccccggaaaagggcactcgtctccgtgggtgtggcggagcgcgcggtgcatgcccgcttttgcggacccgcccccagtctgcgtcagggacagacccctccgccctggatgagcccggcggggaagcttcgcgtagcagtttctgggaaacagcgtgcatggcaggcatttgcattcatgacccttccgtgtacttgaactgaaaacctgaagaaactggccaacagattaggcagccatcaatccacatcagatggcccctgtatttccaagaggaatgggctatgtgaatgaaaaaaggtatccgttatgaaacttccagaaaaacgagctacatttttcagccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacct

SEQ ID NO: 9265 - DNA, 1028 bp, Homo sapiens
ctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatgccgcagcacggtccttggcaaacaaggatgagaaaaatatccaaccacgggagcctgcgggtggcgaaggtggcataccccctggggctgtgtgtgggcgtgttcatctatgttgcctacatcaagtggcaccgggccaccgccacccaggccttcttcagcatcaccagggcagccccgggggcccggtggggtcagcaggcccacagccccctggggacagctgcagacgggcacgaggtcttctacgggatcatgtttgatgcaggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctg

SEQ ID NO: 9266 - DNA, 932 bp, Homo sapiens
caggaagcactggcacccgagtacacgtcttccagttcacccggccccccagagaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaag

SEQ ID NO: 9267 - DNA, 2371 bp, Homo sapiens
gtgcatggggcggagcccaggccctagggaatcgtggggtcgtatcccgcgggtggaggccggggtggcgccggccggggcgggggagcccaaaagaccggctgccgcctgctccccggaaaagggcactcgtctccgtgggtgtggcggagcgcgcggtgcatgaaactcccacgttaacccacgaaaccttcaaagcactgaagccaggtctttctgcctatgctgatgatgttgaaaagagcgctcagggaatccgggaactactggatgttgctaaacaggacattccgttcgacttctggaaggccacccctctggtcctcaaggccacagctggcttacgcctgttacctggagaaaaggcccagaagttactgcagaaggtgaaaaaagtatttaaagcatcgcctttccttgtaggggatgactgtgtttccatcatgaacggaacagatgaaggcgtttcggcgtggatcaccatcaacttcctgacaggcagcttgaaaactccaggagggagcagcgtgggcatgctggacttgggcggaggatccactcagatcgccttcctgccacgcgtggagggcaccctgcaggcctccccacccggctacctgacggcactgcggatgtttaacaggacctacaagctctattcctacagctacctcgggctcgggctgatgtcggcacgcctggcgatcctgggcggcgtggaggggcagcctgctaaggatggaaaggagttggtcagcccttgcttgtctcccagtttcaaaggagagtgggaacacgcagaagtcacgtacagggtttcagggcagaaagcagcggcaagcctgcacgagctgtgtgctgccagagtgtcagaggtccttcaaaacagagtgcacaggacggaggaagtgaagcatgtggacttctatgctttctcctactattacgaccttgcagctggtgtgggcctcatagatgcggagaagggaggcagcctggtggtgggggacttcgagatcgcagccaagtacgtgtgtcggaccctggagacacagccgcagagcagccccttctcatgcatggacctcacctacgtcagcctgctactccaggagttcggctttcccaggagcaaagtgctgaagctcactcggaaaattgacaatgttgagaccagctgggctctgggggccatttttcattacatcgactccctgaacagacagaagagtccagcctcatagtggccgagccatccctgtccccgtcagcagtgtctgtgtgtctgcataaaccctcctgtcctggacgtgacttcatcctgaggagccacagcacaggccgtgctggcactttctgcacactggctctgggacttgcagaaggcctggtgctgccctggcatcagcctcttccagtcacatctggccagagggctgtctggacctgggccctgctcaatgccacctgtctgcctgggctccaagtgggcaggaccaggacagaaccacaggcacacactgagggggcagtgtggctccctgcctgtcccatccccatgccccgtccgcggggctgtggctgctgctgtgcatgtccctgcgatgggagtcttgtctcccagcctgtcagtttcctccccagggcagagctccccttcctgcaagagtctgggaggcggtgcaggctgtcctggctgctctggggaagccgagggacagccataacacccccgggacagtaggtctgggcggcaccactgggaactctggacttgagtgtgtttgcctcttccttgggtatgaatgtgtgagttcacccagaggcctgctctcctcacacattgtgtggtttggggttaatgatggagggagacacctcctcatagacggcaggtgcccacctttcagggagtctcccagcatgggcggatgccgggcatgagctgctgtaaactatttgtggctgtgctgcttgagtgacgtctctgtcgtgtgggtgccaagtgcttgtgtagaaactgtgttctgagcccccttttctggacaccaactgtgtcctgtgaatgtatcgctactgtgagctgttcccgcctagccagggccatgtcttaggtgcagctgtgccacgggtcagctgagccacagtcccagaaccaagctctcggtgtctcgggccaccatccgcccacctcgggctgaccccacctcctccatggacagtgtgagccccgggccgtgcatcctgctcagtgtggcgtcagtgtcggggctgagccccttgagctgcttcagtgaatgtacagtgcccggcacgagctgaacctcatgtgttccactcccaataaaaggttgacaggggcttctccttc

SEQ ID NO: 9268 - DNA, 7442 bp, Homo sapiens
ccggagcggccggggccacgatggagcgcgacggctgcgcggggggcgggagccgcggcggcgagggcgggcgcgctccccgggagggcccggcggggaacggccgcgatcggggccgcagccacgctgccgaggcgcccggggacccgcaggcggccgcgtccttgctggcccctatggacgtgggggaggagccgctggagaaggcggcgcgcgcccgcactgccaaggaccccaacacctataaagtactctcgctggtattgtcagtatgtgtgttaacaacaatacttggttgtatatttgggttgaaaccaagctgtgccaaagaagttaaaagttgcaaaggtcgctgtttcgagagaacatttgggaactgtcgctgtgatgctgcctgtgttgagcttggaaactgctgtttagattaccaggagacgtgcatagaaccagaacatatatggacttgcaacaaattcaggtgtggtgagaaaaggttgaccagaagcctctgtgcctgttcagatgactgcaaggacaagggcgactgctgcatcaactacagttctgtgtgtcaaggtgagaaaagttgggtagaagaaccatgtgagagcattaatgagccacagtgcccagcagggtttgaaacgcctcctaccctcttattttctttggatggattcagggcagaatatttacacacttggggtggacttcttcctgttattagcaaactaaaaaaatgtggaacatatactaaaaacatgagaccggtatatccaacaaaaactttccccaatcactacagcattgtcaccggattgtatccagaatctcatggcataatcgacaataaaatgtatgatcccaaaatgaatgcttccttttcacttaaaagtaaagagaaatttaatcctgagtggtacaaaggagaaccaatttgggtcacagctaagtatcaaggcctcaagtctggcacatttttctggccaggatcagatgtggaaattaacggaattttcccagacatctataaaatgtataatggttcagtaccatttgaagaaaggattttagctgttcttcagtggctacagcttcctaaagatgaaagaccacacttttacactctgtatttagaagaaccagattcttcaggtcattcatatggaccagtcagcagtgaagtcatcaaagccttgcagagggttgatggtatggttggtatgctgatggatggtctgaaagagctgaacttgcacagatgcctgaacctcatccttatttcagatcatggcatggaacaaggcagttgtaagaaatacatatatctgaataaatatttgggggatgttaaaaatattaaagttatctatggacctgcagctcgattgagaccctctgatgtcccagataaatactattcatttaactatgaaggcattgcccgaaatctttcttgccgggaaccaaaccagcacttcaaaccttacctgaaacatttcttacctaagcgtttgcactttgctaagagtgatagaattgagcccttgacattctatttggaccctcagtggcaacttgcattgaatccctcagaaaggaaatattgtggaagtggatttcatggctctgacaatgtattttcaaatatgcaagccctctttgttggctatggacctggattcaagcatggcattgaggctgacacctttgaaaacattgaagtctataacttaatgtgtgatttactgaatttgacaccggctcctaataacggaactcatggaagtcttaaccaccttctaaagaatcctgtttatacgccaaagcatcccaaagaagtgcaccccctggtacagtgccccttcacaagaaaccccagagataaccttggctgctcatgtaacccttcgattttgccgattgaggattttcaaacacagttcaatctgactgtggcagaagagaagattattaagcatgaaactttaccctatggaagacctagagttctccagaaggaaaacaccatctgtcttctttcccagcaccagtttatgagtggatacagccaagacatcttaatgcccctttggacatcctataccgtggacagaaatgacagtttctctacggaagacttctccaactgtctgtaccaggactttagaattcctcttagtcctgtccataaatgttcattttataaaaataacaccaaagtgagttacgggttcctctccccaccacaactaaataaaaattcaagtggaatatattctgaagctttgcttactacaaatatagtgccaatgtaccagagttttcaagttatatggcgctactttcatgacaccctactgcgaaagtatgctgaagaaagaaatggtgtcaatgtcgtcagtggtcctgtgtttgactttgattatgatggacgttgtgattccttagagaatctgaggcaaaaaagaagagtcatccgtaaccaagaaattttgattccaactcacttctttattgtgctaacaagctgtaaagatacatctcagacgcctttgcactgtgaaaacctagacaccttagctttcattttgcctcacaggactgataacagcgagagctgtgtgcatgggaagcatgactcctcatgggttgaagaattgttaatgttacacagagcacggatcacagatgttgagcacatcactggactcagcttctatcaacaaagaaaagagccagtttcagacattttaaagttgaaaacacatttgccaacctttagccaagaagactgatatgttttttatccccaaacaccatgaatctttttgagagaaccttatattttatatagtcctctagctacactattgcattgttcagaaactgtcgaccagagttagaacggagccctcggtgatgcggacatctcagggaaacttgcgtactcagcacagcagtggagagtgttcctgttgaatcttgcacatatttgaatgtgtaagcattgtatacattgatcaagttcgggggaataaagacagaccacacctaaaactgcctttctgcttctcttaaaggagaagtagctgtgaacattgtctggataccagatatttgaatctttcttactattggtaataaaccttgatggcattgggcaaacagtagacttatagtagggttggggtagcccatgttatgtgactatctttatgagaattttaaagtggttctggatatcttttaacttggagtttcatttcttttcattgtaatcaaaaaaaaaattaacagaagccaaaatacttctgagaccttgtttcaatctttgctgtatatcccctcaaaatccaagttattaatcttatgtgttttctttttaattttttgattggatttctttagatttaatggttcaaatgagttcaactttgagggacgatctttgaatatacttacctattataaaatcttactttgtatttgtatttaaaaaagaaaaatattcctatcctgctcactggtaattaacataggtttaaaatggcttcaaatgtggccctatagacggttaaaattgtaccttatcttggcaaaacttcagagcaccagtcagtgcatgcaaggtgccattttttattgagatgcttagaatgtttctttctgtgcacaagacttaccctaccagcagcagagccattctctgttgagtggttcattttgaagttccacagattgaagagaacatgccaccaatcacctcacatcttcttggtggacatgataaatgacacaatgaacttgatttctttactaccttgactgtagctttttatccctacctgtgaaccttcaaagactgcattaacttttaggctacataggtccaattgaggtataatatcagtacaccaaagatttttatatgtccttcgtgtgaccattcttcaacggcctaagggccagctgcaaagacttttggaaaatacaatttacaactcaaaattatttaataatttaggaagttgctttttttttttttttttttcagtcctgcagtttcctgaagctctgtatatgatatttttttcagcctgcttctctctgttgttcagattaggtaattttattcttctgtctcgaagctcactgattctttattctgtctaatctgttctgctgttgagcccatttattcctgatttttatattttagttattgtatgttttatttctaaaatttccattcagtttttctttatatcttctatttgctgagaatttctgtctctttgctgagactttctacgttttcatttgtttcaagtgcatttatacttgcttgttgaagaatttttatgatggctgctgtaaaatccttatcagataattccaacatctgtcacctcattgtttgcatctactgatggtcttttttccattcggaaacattttcctgtttcttggtgtgtggaatgattttttattgaaacctggatatttttaggtattatgttatgagactatgggtcttatttaaaccttctgctttagccaactttctcagataccaccacagcaggggaattgggagcactgcttcattattaccaggtgtggctaggagtccaggttccccagtcagcctccctttatactgagtaacagggtcccctcattactactgggcaaggtgagaattcagtttcccattaggtctttattgattcttccctggctggaatgtgcagcggcaccttttggtgcaccctgggaatctccactaatgctatgggacagagtgaccaggaagagcttcattacaccaggtgggaatgaaattcccagtagcctacacagccttctccgacaccactctggagttgtattcttccagcacacaaacatacacaatttaactcaaagcatcttagcagagcttaattaaatggatagatgcctgttccctttgctggataccaagaatacaaaagtcagggagttggggcacctctttacagcttggtgagagtgtaagtctggactccccactcagcatttgctggtatgggtggggccatggtgtttttccatggtgtttggttggagtacagccttttttacccttgcttggctacccttttctggtcctttggcaggagagagcaggactctcttagggcttttttttcccctgcatttattgacatttccaggttgctgactttttcagctccaagttggaaatatatgagctgaaaagaaaatgtagggaactcatcacagtgttgttacttgggccccaatgttcctagcctattttctgtctactattcagagtcttgctgtgttttaatataatatccaggatttttatatgcatttagcagaaggatgtctactctgcctttgtagaagtgtctcactgatttttacatatttttccagcacacaaacatacacaatttaactcaaagcatcttagcagagcttaattaaatggatagatgtctgttccctttgctggacgccaagaatacaaaaaagaacaagtgacaattttctctgtcttagggagaagagacagcagaagtgtaaatgatccctaaagagtgatagatgttatcatgaagccacaggaggggtgccaggctgcacaaaagagacactggatgcttcttggtagtagaggcagtggcttcccagccttggggctaaggcttgtagggtgaattggaacttttcagatgagcaaggcaaagaagggaccttctaacattccttggatggaacatttttgacattttcccatttacagctacttatattttctacaagtgtcactgtgaccaacttatgtacacatactttttcttgcttagttataataatctgttcttaaagaaaatgtcagtctctacattctatgctgactgttaaggaaagagcacccacatctgctcctacttagctttttttctgtggttcttacacagtattcctttttttcttttcttgaaagagactcctcctttcttttcttttcttgaaagagttttaaacagataagatggcaaaagtgactgatctctactcccccagtttgaatggtaaatttgaatggtaaattcccatgaacatatatggaaatgtctttatcctactttctccaataaaggctgttcttagcttttcaaatgcaaagtgaaacctttatttatcttgatttcttttttttttttttttttttttttttttttgagatgctctgtcacccaggctggagtgcagtggcaagatcttggctcactgcaagctccgcctcccaggttcacgccattctcctggctcagcctcccgagtaactgggactacaggcacctgccgtcacgcctggctaattttttgtatttttagtagagaatggagtttcaccgtgttagccaggatggtctcgatctcctgaccttgtgatctgcccgcctcggcctcccaaagtgctgggattacaggctcgagccactgcctccagcctatcctgatttctactgtcatgcctcacatcagtccttttttttttttttgagacagagtctcgctctgtggcccaggctagactgcagtggcatgatctcggctcactgcaacctccacctccggggttctagcaattctcctgcctcagcctcctgagtagctgggattataggcgcatgccacacctggctttttgtattttagtggagatggggtttcactgtgttgctcaggctggtcttgatctcctgagctcagacaatccccccgccttggcctcccaaagtgctaggattataggcgagagctgctgtgtgcttcttaagtgaggtaagtaacttccatagaaaatttccatcagttcattcatgaaagaacaaagaacctggcaaaacttaaaaaaacgtttccaagaatcagataaaagaggacaaaccttagggagaagaaggcagctgctcatttccagcaggggaagtagctgcatagagtacaaggactggtaggcctgttggctgttcctgtttaaggagacaagatgggcatggaacagggaccaccccctcctctgggagaagctgttacccccttcacttttcctcctctgtcattacccacaatcactctccttctttgcgctatggtaggtgtttacccatcataggaatgggcatttgaactttgaaactgaatgtggtgattacacttcatgctgaagcttttcacatgagtgctttcataagcattaagtaaaattttataatgactgcagtccaaggacattttccctggtttttggccagtctaaatattgtaagagagagagaagaaaagtgtacggaatataattgtctctaagctaagaaatgtggatgttcaaataaaacatacgtacagaa

SEQ ID NO: 9269 - DNA, 2651 bp, Homo sapiens
agtgcactccgtgaaggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgagatgacaaatcctctgagggaaatcgacaaaattgtggggcaattaatggatggactgaaacaactaaaactgcatcggtgtgtcaacgtcatctttgtcggagaccatggaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggctcaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaa

SEQ ID NO: 9270 - DNA, 3233 bp, Homo sapiens
cgtgaaggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgaggagagtagttatggctcaccttttactccggctaagagacctaagaggaaagttgcccctaagaggagacaggaaagaccagttgctcctccaaagaaaagaagaagaaaaatacataggatggatcattatgctgcggaaactcgtcaggacaaaatgacaaatcctctgagggaaatcgacaaaattgtggggcaattaatggatggactgaaacaactaaaactgcatcggtgtgtcaacgtcatctttgtcggagaccatggaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggctcaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtaccaaatctgacatattatgcctgaatgactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagtttt

SEQ ID NO: 9271 - DNA, 2667 bp, Homo sapiens
atggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgagatgacaaatcctctgagggaaatcgacaaaattgtggggcaattaatggatggactgaaacaactaaaactgcatcggtgtgtcaacgtcatctttgtcggagaccatggaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggctcaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagctgaaaccaggaaattcagaggcagcagaaatgaaaacaaggaaaacattaatggaaattttgaacctagaaaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaa

SEQ ID NO: 9272 - DNA, 3154 bp, Homo sapiens
atacagtttctctttgccagactagactaaagaaggagcactaatttattctgataaaacaggtctatgcagctaccaggacaatggaatctacgttgactttagcaacggaacaacctgttaagaagaacactcttaagaaatataaaatagcttgcattgttcttcttgctttgctggtgatcatgtcacttggattaggcctggggcttggactcaggaaactggaaaagcaaggcagctgcaggaagaagtgctttgatgcatcatttagaggactggagaactgccggtgtgatgtggcatgtaaagaccgaggtgattgctgctgggattttgaagacacctgtgtggaatcaactcgaatatggatgtgcaataaatttcgttgtggagagaccagattagaggccagcctttgctcttgttcagatgactgtttgcagaggaaagattgctgtgctgactataagagtgtttgccaaggagaaacctcatggctggaagaaaactgtgacacagcccagcagtctcagtgcccagaagggtttgacctgccaccagttatcttgttttctatggatggatttagagctgaatatttatacacatgggatactttaatgccaaatatcaataaactgaaaacatgtggaattcattcaaaatacatgagagctatgtatcctaccaaaaccttcccaaatcattacaccattgtcacgggcttgtatccagagtcacatggcatcattgacaataatatgtatgatgtaaatctcaacaagaatttttcactttcttcaaaggaacaaaataatccagcctggtggcatgggcaaccaatgtggctgacagcaatgtatcaaggtttaaaagccgctacctacttttggcccggatcagaagtggctataaatggctcctttccttccatatacatgccttacaacggaagtgtcccatttgaagagaggatttctacactgttaaaatggctggacctgcccaaagctgaaagacccaggttttataccatgtattttgaagaacctgattcctctggacatgcaggtggaccagtcagtgccagagtaattaaagccttacaggtagtagatcatgcttttgggatgttgatggaaggcctgaagcagcggaatttgcacaactgtgtcaatatcatccttctggctgaccatggaatggaccagacttattgtaacaagatggaatacatgactgattattttcccagaataaacttcttctacatgtacgaagggcctgccccccgcatccgagctcataatatacctcatgacttttttagttttaattctgaggaaattgttagaaacctcagttgccgaaaacctgatcagcatttcaagccctatttgactcctgatttgccaaagcgactgcactatgccaagaacgtcagaatcgacaaagttcatctctttgtggatcaacagtggctggctgttaggagtaaatcaaatacaaattgtggaggaggcaaccatggttataacaatgagtttaggagcatggaggctatctttctggcacatggacccagttttaaagagaagactgaagttgaaccatttgaaaatattgaagtctataacctaatgtgtgatcttctacgcattcaaccagcaccaaacaatggaacccatggtagtttaaaccatcttctgaaggtgcctttttatgagccatcccatgcagaggaggtgtcaaagttttctgtttgtggctttgctaatccattgcccacagagtctcttgactgtttctgccctcacctacaaaatagtactcagctggaacaagtgaatcagatgctaaatctcacccaagaagaaataacagcaacagtgaaagtaaatttgccatttgggaggcctagggtactgcagaagaacgtggaccactgtctcctttaccacagggaatatgtcagtggatttggaaaagctatgaggatgcccatgtggagttcatacacagtcccccagttgggagacacatcgcctctgcctcccactgtcccagactgtctgcgggctgatgtcagggttcctccttctgagagccaaaaatgttccttctatttagcagacaagaatatcacccacggcttcctctatcctcctgccagcaatagaacatcagatagccaatatgatgctttaattactagcaatttggtacctatgtatgaagaattcagaaaaatgtgggactacttccacagtgttcttcttataaaacatgccacagaaagaaatggagtaaatgtggttagtggaccaatatttgattataattatgatggccattttgatgctccagatgaaattaccaaacatttagccaacactgatgttcccatcccaacacactactttgtggtgctgaccagttgtaaaaacaagagccacacaccggaaaactgccctgggtggctggatgtcctaccctttatcatccctcaccgacctaccaacgtggagagctgtcctgaaggtaaaccagaagctctttgggttgaagaaagatttacagctcacattgcccgggtccgtgatgtagaacttctcactgggcttgacttctatcaggataaagtgcagcctgtctctgaaattttgcaactaaagacatatttaccaacatttgaaaccactatttaacttaataatgtctacttaatatataatttactgtataaagtaattttggcaaaatataagtgatttttttctggagaattgtaaaataaagttttctatttttccttaagtcccctaaaagccataatttttattattcctttttctcttttttcaattctatgaatatgtattattttaaagttatatttttcacacagagatgatgctatattacaccttcccttttttgttggtttcttaaactctaatctcatgacagattataccttccttattacttgttttatcttactcagaatctttgaatatatttttctgcccagaattatctaaacaaaagggagaacaaaagaagtatgtctcacttgggaactgaatcaactctaaatcagttttgtcacaaaactttttgtatttgactggcaatgctgattaaaatt

SEQ ID NO: 9273 - DNA, 2492 bp, Homo sapiens
atggaatctacgttgactttagcaacggaacaacctgttaagaagaacactcttaagaaatataaaatagcttgcattgttcttcttgctttgctggtgatcatgtcacttggattaggcctggggcttggactcaggaaactggaaaagcaaggcagctgcaggaagaagtgctttgatgcatcatttagaggactggagaactgccggtgtgatgtggcatgtaaagaccgaggtgattgctgctgggattttgaagacacctgtgtggaatcaactcgaatatggatgtgcaataaatttcgttgtggagagaccagattagaggccagcctttgctcttgttcagatgactgtttgcagaggaaagattgctgtgctgactataagagtgtttgccaaggagaaacctcatggctggaagaaaactgtgacacagcccagcagtctcagtgcccagaagggtttgacctgccaccagttatcttgttttctatggatggatttagagctgaatatttatacacatgggatactttaatgccaaatatcaataaactgaaaacatgtggaattcattcaaaatacatgagagctatgtatcctaccaaaaccttcccaaatcattacaccattgtcacgggcttgtatccagagtcacatggcatcattgacaataatatgtatgatgtaaatctcaacaagaatttttcactttcttcaaaggaacaaaataatccagcctggtggcatgggcaaccaatgtggctgacagcaatgtatcaaggtttaaaagccgctacctacttttggcccggatcagaagtggctataaatggctcctttccttccatatacatgccttacaacggaagtgtcccatttgaagagaggatttctacactgttaaaatggctggacctgcccaaagctgaaagacccaggttttataccatgtattttgaagaacctgattcctctggacatgcaggtggaccagtcagtgccagagtaattaaagccttacaggtagtagatcatgcttttgggatgttgatggaaggcctgaagcagcggaatttgcacaactgtgtcaatatcatccttctggctgaccatggaatggaccagacttattgtaacaagatggaatacatgactgattattttcccagaataaacttcttctacatgtacgaagggcctgccccccgcatccgagctcataatatacctcatgacttttttagttttaattctgaggaaattgttagaaacctcagttgccgaaaacctgatcagcatttcaagccctatttgactcctgatttgccaaagcgactgcactatgccaagaacgtcagaatcgacaaagttcatctctttgtggatcaacagtggctggctgttaggagtaaatcaaatacaaattgtggaggaggcaaccatggttataacaatgagtttaggagcatggaggctatctttctggcacatggacccagttttaaagagaagactgaagttgaaccatttgaaaatattgaagtctataacctaatgtgtgatcttctacgcattcaaccagcaccaaacaatggaacccatggtagtttaaaccatcttctgaaggtgcctttttatgagccatcccatgcagaggaggtgtcaaagttttctgtttgtggctttgctaatccattgcccacagagtctcttgactgtttctgccctcacctacaaaatagtactcagctggaacaagtgaatcagatgctaaatctcacccaagaagaaataacagcaacagtgaaagtaaatttgccatttgggaggcctagggtactgcagaagaacgtggaccactgtctcctttaccacagggaatatgtcagtggatttggaaaagctatgaggatgcccatgtggagttcatacacagtcccccagttgccagcaatagaacatcagatagccaatatgatgctttaattactagcaatttggtacctatgtatgaagaattcagaaaaatgtgggactacttccacagtgttcttcttataaaacatgccacagaaagaaatggagtaaatgtggttagtggaccaatatttgattataattatgatggccattttgatgctccagatgaaattaccaaacatttagccaacactgatgttcccatcccaacacactactttgtggtgctgaccagttgtaaaaacaagagccacacaccggaaaactgccctgggtggctggatgtcctaccctttatcatccctcaccgacctaccaacgtggagagctgtcctgaaggtaaaccagaagctctttgggttgaagaaagatttacagctcacattgcccgggtccgtgatgtagaacttctcactgggcttgacttctatcaggataaagtgcagcctgtctctgaaattttgcaactaaagacatatttaccaacatttgaaaccactatttaa

SEQ ID NO: 9274 - DNA, 3413 bp, Homo sapiens
gagaaatgaaaagtttggaacccagaagctgcagcctgcggaaaatgctggagccgcagccgacaccaagttgatgtctgtgagcagctgaccttctggacctccatcagcggcctgcagccaggagctgaagccacagagacggtgtcttctcagctatgataacctcagtgcaaatattgcccaatcactgaagagctgtgatcttcctaaacagttaaaagtcaggcacagctatgtaactcatacagtttctctttgccagactagactaaagaaggagcactaatttattctgataaaacaggtctatgcagctaccaggacaatggaatctacgttgactttagcaacggaacaacctgttaagaagaacactcttaagaaatataaaatagcttgcattgttcttcttgctttgctggtgatcatgtcacttggattaggcctggggcttggactcaggaaactggaaaagcaaggcagctgcaggaagaagtgctttgatgcatcatttagaggactggagaactgccggtgtgatgtggcatgtaaagaccgaggtgattgctgctgggattttgaagacacctgtgtggaatcaactcgaatatggatgtgcaataaatttcgttgtggagagaccagattagaggccagcctttgctcttgttcagatgactgtttgcagaggaaagattgctgtgctgactataagagtgtttgccaaggagaaacctcatggctggaagaaaactgtgacacagcccagcagtctcagtgcccagaagggtttgacctgccaccagttatcttgttttctatggatggatttagagctgaatatttatacacatgggatactttaatgccaaatatcaataaactgaaaacatgtggaattcattcaaaatacatgagagctatgtatcctaccaaaaccttcccaaatcattacaccattgtcacgggcttgtatccagagtcacatggcatcattgacaataatatgtatgatgtaaatctcaacaagaatttttcactttcttcaaaggaacaaaataatccagcctggtggcatgggcaaccaatgtggctgacagcaatgtatcaaggtttaaaagccgctacctacttttggcccggatcagaagtggctataaatggctcctttccttccatatacatgccttacaacggaagtgtcccatttgaagagaggatttctacactgttaaaatggctggacctgcccaaagctgaaagacccaggttttataccatgtattttgaagaacctgattcctctggacatgcaggtggaccagtcagtgccagagtaattaaagccttacaggtagtagatcatgcttttgggatgttgatggaaggcctgaagcagcggaatttgcacaactgtgtcaatatcatccttctggctgaccatggaatggaccagacttattgtaacaagatggaatacatgactgattattttcccagaataaacttcttctacatgtacgaagggcctgccccccgcatccgagctcataatatacctcatgacttttttagttttaattctgaggaaattgttagaaacctcagttgccgaaaacctgatcagcatttcaagccctatttgactcctgatttgccaaagcgactgcactatgccaagaacgtcagaatcgacaaagttcatctctttgtggatcaacagtggctggctgttaggagtaaatcaaatacaaattgtggaggaggcaaccatggttataacaatgagtttaggagcatggaggctatctttctggcacatggacccagttttaaagagaagactgaagttgaaccatttgaaaatattgaagtctataacctaatgtgtgatcttctacgcattcaaccagcaccaaacaatggaacccatggtagtttaaaccatcttctgaaggtgcctttttatgagccatcccatgcagaggaggtgtcaaagttttctgtttgtggctttgctaatccattgcccacagagtctcttgactgtttctgccctcacctacaaaatagtactcagctggaacaagtgaatcagatgctaaatctcacccaagaagaaataacagcaacagtgaaagtaaatttgccatttgggaggcctagggtactgcagaagaacgtggaccactgtctcctttaccacagggaatatgtcagtggatttggaaaagctatgaggatgcccatgtggagttcatacacagtcccccagttgggagacacatcgcctctgcctcccactgtcccagactgtctgcgggctgatgtcagggttcctccttctgagagccaaaaatgttccttctatttagcagacaagaatatcacccacggcttcctctatcctcctgccagcaatagaacatcagatagccaatatgatgctttaattactagcaatttggtacctatgtatgaagaattcagaaaaatgtgggactacttccacagtgttcttcttataaaacatgccacagaaagaaatggagtaaatgtggttagtggaccaatatttgattataattatgatggccattttgatgctccagatgaaattaccaaacatttagccaacactgatgttcccatcccaacacactactttgtggtgctgaccagttgtaaaaacaagagccacacaccggaaaactgccctgggtggctggatgtcctaccctttatcatccctcaccgacctaccaacgtggagagctgtcctgaaggtaaaccagaagctctttgggttgaagaaagatttacagctcacattgcccgggtccgtgatgtagaacttctcactgggcttgacttctatcaggataaagtgcagcctgtctctgaaattttgcaactaaagacatatttaccaacatttgaaaccactatttaacttaataatgtctacttaatatataatttactgtataaagtaattttggcaaaatataagtgatttttttctggagaattgtaaaataaagttttctatttttccttaagtcccctaaaagccataatttttattattcctttttctcttttttcaattctatgaatatgtattattttaaagttatatttttcacacagagatgatgctatattacaccttcccttttttgttggtttcttaaactctaatctcatgacagattataccttccttattacttgttttatcttactcagaatctttgaatatatttttctgcccagaattatctaaacaaaagggagaacaaaagaagtatgtctcacttgggaactgaatcaactctaaatcagttttgtcacaaaactttttgtatttgactggcaatgctgattaaaattaaaaatgcacagaa

SEQ ID NO: 9275 - DNA, 1400 bp, Homo sapiens
atacagtttctctttgccagactagactaaagaaggagcactaatttattctgataaaacaggtctatgcagctaccaggacaatggaatctacgttgactttagcaacggaacaacctgttaagaagaacactcttaagaaatataaaatagcttgcattggtctctctcctttgggatctcacctcaccacaacctctgtttcccaggctcaagtgatcctcctgcctcagcctcctgagtagcttggaccacaggcacatgccacaaggctcagctaagtttttgttcttcttgctttgctggtgatcatgtcacttggattaggcctggggcttggactcaggaaactggaaaagcaaggcagctgcaggaagaagtgctttgatgcatcatttagaggactggagaactgccggtgtgatgtggcatgtaaagaccgaggtgattgctgctgggattttgaagacacctgtgtggaatcaactcgaatatggatgtgcaataaatttcgttgtggagagaccagattagaggccagcctttgctcttgttcagatgactgtttgcagaggaaagattgctgtgctgactataagagtgtttgccaaggagaaacctcatggctggaagaaaactgtgacacagcccagcagtctcagtgcccagaagggtttgacctgccaccagttatcttgttttctatggatggatttagagctgaatatttatacacatgggatactttaatgccaaatatcaataaactgaaaacatgtggaattcattcaaaatacatgagagctatgtatcctaccaaaaccttcccaaatcattacaccattgtcacgggcttgtatccagagtcacatggcatcattgacaataatatgtatgatgtaaatctcaacaagaatttttcactttcttcaaaggaacaaaataatccagcctggtggcatgggcaaccagtatgtagcattctacacgtcgcaactgaagtaacctccatttctcagtgtgacaggaggacactcttctcactcagtggagcaagttctatgtcacccatctagtttctaagggctgagggtgcaaagatgtggctgacagcaatgtatcaaggtttaaaagccgctacctacttttggcccggatcagaagtggctataaatggctcctttccttccatatacatgccttacaacggaagtgtcccatttgaagagaggatttctacactgttaaaatggctggacctgcccaaagctgaaagacccaggttttataccatgtattttgaagaacctgattcctctggacatgcaggtggaccagtcagtgccagagtaattaaagccttacaggtagtagatcatgcttttgggatgttgatggaa

SEQ ID NO: 9276 - DNA, 1430 bp, Homo sapiens
atacagtttctctttgccagactagactaaagaaggagcactaatttattctgataaaacaggtctatgcagctaccaggacaatggaatctacgttgactttagcaacggaacaacctgttaagaagaacactcttaagaaatataaaatagcttgcattagactgggtttcaccatgttgcccaggctggtctcaaactcctggatcaagtgatctacctgcctcggcctcccaaagtgctgggactacaggcatgaaccactgcacctggcctctagtgttttcctcagccaagaattccaagttcttcttgctttgctggtgatcatgtcacttggattaggcctggggcttggactcaggaaactggaaaagcaaggcagctgcaggaagaagtgctttgatgcatcatttagaggactggagaactgccggtgtgatgtggcatgtaaagaccgaggtgattgctgctgggattttgaagacacctgtgtggaatcaactcgaatatggatgtgcaataaatttcgttgtggagagaccagattagaggccagcctttgctcttgttcagatgactgtttgcagaggaaagattgctgtgctgactataagagtgtttgccaaggagaaacctcatggctggaagaaaactgtgacacagcccagcagtctcagtgcccagaagggtttgacctgccaccagttatcttgttttctatggatggatttagagctgaatatttatacacatgggatactttaatgccaaatatcaataaactgaaaacatgtggaattcattcaaaatacatgagagctatgtatcctaccaaaaccttcccaaatcattacaccattgtcacgggcttgtatccagagtcacatggcatcattgacaataatatgtatgatgtaaatctcaacaagaatttttcactttcttcaaaggaacaaaataatccagcctggtggcatgggcaaccaatgtggctgacagcaatgtatcaaggtttaaaagccgctacctacttttggcccggatcagaagtggctataaatggctcctttccttccatatacatgccttacaacgggtagtgaagcactttcagatattctcccagctaggcagaaatgatcaagatgttttctgtcttaatcttggtggcaattctattaatccagttgtttaagccaaaaatcttgggaatcaccattgattcctttcctttatgtcactcaagcagtctctcagtaaatgcttttggctgtaattaaaaatctatgtagcctgagaactttttattacctctagcattaccactctggttcgagctgtcatctcttgcctgtattaactgcagttgcctctttactcatctctgcttcttatcctttataatctagtctcatcccacccaccag

SEQ ID NO: 9277 - DNA, 1918 bp, Homo sapiens
caacaacgtggcctggaggcaatggccctggcctctcgtgtccccttctctcacccgcccagacttgccctctttggaggtcgcccgggctaaggtcttctccactggcccctgagattgccatcacctccagctcctcctctcctgaagttggcagcccctcctgggttccagcctcctgagatgccagacccactggggcagtacccacaggccctgagcctacatcaaccaccccagtgacaccccaagcctgcagcattttccacccccagccccctggtcccaccttgccttccgcccaccttcccacctgctgcagggagggccctcggctgagccttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctgaggagctgtttctgctgtgtgacaaggaggctaagggcttcatcaccaagcacgacctgcagggtctccagagcgacctgcccctcacgccagagcagctggaggctgtgtttgaaagtctggaccgggctcacactggcttcctcaccgccagggagttctgcctgggcctggggatgtttgtgggggtggcgtcagcccagggagcgaacccctgcaggactcccgaggagacctttgagtcgggcgggctcgacgtgcagggcacggcgggctctctggatgaggaggaggaagaggaggagcgattccacactgtgctggagcagctgggggtggccccggtcctgggcaagcagcgggctgtgaggacgctctgggccaggctgcagcgcgagcgccccgagctgctgggctctttcgaggatgttctgatacgcgcgtcggcctgcctggaggaggcggcccgggagcgcgacggcctggagcaggcgctgcggaggcgcgagagcgagcacgagagggaggtgcgcgctctgtacgaggagacggagcagcttcgggagcagagccggcgcccgccgagtcagaacttcgcccgcggggagcggagaagccgtctggagctggagctgcagagccgcgagcaggacctggaacgcgcgggcctgcggcagcgggagttagagcagcagctgcacgcccaggctgcggagcacctggaggcacaggcccagaactcccagctgtggcgggcgcacgaggcgctgcgaacgcagctggagggggcgcaggagcagatccgcaggctggagagcgaagcacgaggccgccaggagcaaacccaacgagacgtggtcgccgtctccaggaacatgcagaaagagaaagtcagcctgctacggcaactggagctgctcagggagctgaatacacggctgcgggatgacagggacgcctgcgaggccaggcgggcgggcagcagctgcaggaaggctctgacaacagcccgcctgcctgggcccacctgctgctgctgctgttgctgggctcggccccccagacgcggctctggccaccttcccagtgcccggtgaccagccccgagtgactcacggaccatgagctagaagctgcccttgcaggaggcttgtcatgggtcgggggtgcccactcaggatgcaggctctccccagtgggccccaggctcgcctgactgaagacatgaaggacctagcctaggagtggtcagggtcccgggagtggccagggtcccgtgtgtgccctctgccagtcttcgctctgtccccgttcaatcaaccccatctcagttcagcagaaaaccccctcgtcaaataaaacccactgactgc

SEQ ID NO: 9278 - DNA, 1820 bp, Homo sapiens
aggtctagccggcaagccggagggcgggcgagacaacaacgtggcctggaggcaatggccctggcctctcgtgtccccttctctcacccgcccagacttgccctctttggaggtcgcccgggctaagctttcaggaccccaccttccttatcaccaggtcttctccactggcccctgagattgccatcacctccagctcctcctctcctgaagttggcagcccctcctgggttccagcctcctgagatgccagacccactggggcagtacccacaggccctgagcctacatcaaccaccccagtgacaccccaagcctgcagcattttccacccccagccccctggtcccaccttgccttccgcccaccttcccacctgctgcagggagggccctcggctgagccttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctgaggagctgtttctgctgtgtgacaaggaggctaagggcttcatcaccaagcacgacctgcagggtctccagagcgacctgcccctcacgccagagcagctggaggctgtgtttgaaagtctggaccgggctcacactggcttcctcaccgccagggagttctgcctgggcctggggatgtttgtgggggtggcgtcagcccagggagcgaacccctgcaggactcccgaggagacctttgagtcgggcgggctcgacgtgcagggcacggcgggctctctggatgaggaggaggaagaggaggagcgattccacactgtgctggagcagctgggggtggccccggtcctgggcaagcagcgggctgtgaggacgctctgggccaggctgcagcgcgagcgccccgagctgctgggctctttcgaggatgttctgatacgcgcgtcggcctgcctggaggaggcggcccgggagcgcgacggcctggagcaggcgctgcggaggcgcgagagcgagcacgagagggaggtgcgcgctctgtacgaggagacggagcagcttcgggagcagagccggcgcccgccgagtcagaacttcgcccgcggggagcggagaagccgtctggagctggagctgcagagccgcgagcaggacctggaacgcgcgggcctgcggcagcgggagagacgtggtcgccgtctccaggaacatgcagaaagagaaagtcagcctgctacggcaactggagctgctcagggagctgaatacacggctgcgggatgacagggacgcctgcgaggccaggcgggcgggcagcagctgcaggaaggctctgacaacagcccgcctgcctgggcccacctgctgctgctgctgttgctgggctcggccccccagacgcggctctggccaccttcccagtgcccggtgaccagccccgagtgactcacggaccatgagctagaagctgcccttgcaggaggcttgtcatgggtcgggggtgcccactcaggatgcaggctctccccagtgggccccaggctcgcctgactgaagacatgaaggacctagcctaggagtggtcagggtcccgggagtggccagggtcccgtgtgtgccctctgccagtcttcgctctgtccccgttcaatcaaccccatctcagttcagcagaaaaccccctcgtcaaataaaacccactgactgcactgcg

SEQ ID NO: 9279 - DNA, 824 bp, Homo sapiens
ggcggggcgcgcccagtgtttccgggaggagcggcccgggcgcgcggcaggtgcggcggcgcaactcgcgggtaggcgaccgctggtcccgccgctgaggcccctccactgccgcccgcccggcaccccctccgggccgccgtggcccgcgccaaacctgagcgtctcggtcgggaactccggttaccccctcggggcgcaaggcggcaggggtcttctccactggcccctgagattgccatcacctccagctcctcctctcctgaagttggcagcccctcctgggttccagcctcctgagatgccagacccactggggcagtacccacaggccctgagcctacatcaaccaccccagtgacaccccaagcctgcagcattttccacccccagccccctggtcccaccttgccttccgcccaccttcccacctgctgcagggagggccctcggctgagccttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctgaggagctgtttctgctgtgtgacaaggaggctaagggcttcatcaccaagcacgacctgcagggtctccagagcgacctgcccctcacgccagagcagctggaggctgtgtttgaaagtctggaccgggctcacactggcttcctcaccgccagggagttc

SEQ ID NO: 9280 - DNA, 575 bp, Homo sapiens
ctataagcccagccttttgtggttcagctgggtcgcacgctggatcccaggccccttccttgaaaagcagaggccttgtaccccccagggttgccgggcgggacagtgattccagcccttcaggtcttctccactggcccctgagattgccatcacctccagctcctcctctcctgaagttggcagcccctcctgggttccagcctcctgagatgccagacccactggggcagtacccacaggccctgagcctacatcaaccaccccagtgacaccccaagcctgcagcattttccacccccagccccctggtcccaccttgccttccgcccaccttcccacctgctgcagggagggccctcggctgagccttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctga

SEQ ID NO: 9281 - DNA, 1786 bp, Homo sapiens
ggacctcaggtctagccggcaagccggagggcgggcgagacaacaacgtggcctggaggcaatggccctggcctctcgtgtccccttctctcacccgcccagacttgccctctttggaggtcgcccgggtcttctccactggcccctgagattgccatcacctccagctcctcctctcctgaagttggcagcccctcctgggttccagcctcctgagatgccagacccactggggcagtacccacaggccctgagcctacatcaaccaccccagtgacaccccaagcctgcagcattttccacccccagccccctggtcccaccttgccttccgcccaccttcccacctgctgcagggagggccctcggctgagccttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctgaggagctgtttctgctgtgtgacaaggaggctaagggcttcatcaccaagcacgacctgcagggtctccagagcgacctgcccctcacgccagagcagctggaggctgtgtttgaaagtctggaccgggctcacactggcttcctcaccgccagggagttctgcctgggcctggggatgtttgtgggggtggcgtcagcccagggagcgaacccctgcaggactcccgaggagacctttgagtcgggcgggctcgacgtgcagggcacggcgggctctctggatgaggaggaggaagaggaggagcgattccacactgtgctggagcagctgggggtggccccggtcctgggcaagcagcgggctgtgaggacgctctgggccaggctgcagcgcgagcgccccgagctgctgggctctttcgaggatgttctgatacgcgcgtcggcctgcctggaggaggcggcccgggagcgcgacggcctggagcaggcgctgcggaggcgcgagagcgagcacgagagggaggtgcgcgctctgtacgaggagacggagcagcttcgggagcagagccggcgcccgccgagtcagaacttcgcccgcggggagcggagaagccgtctggagctggagctgcagagccgcgagcaggacctggaacgcgcgggcctgcggcagcgggagagacgtggtcgccgtctccaggaacatgcagaaagagaaagtcagcctgctacggcaactggagctgctcagggagctgaatacacggctgcgggatgacagggacgcctgcgaggccaggcgggcgggcagcagctgcaggaaggctctgacaacagcccgcctgcctgggcccacctgctgctgctgctgttgctgggctcggccccccagacgcggctctggccaccttcccagtgcccggtgaccagccccgagtgactcacggaccatgagctagaagctgcccttgcaggaggcttgtcatgggtcgggggtgcccactcaggatgcaggctctccccagtgggccccaggctcgcctgactgaagacatgaaggacctagcctaggagtggtcagggtcccgggagtggccagggtcccgtgtgtgccctctgccagtcttcgctctgtccccgttcaatcaaccccatctcagttcagcagaaaaccccctcgtcaaataaaacccactgactgca

SEQ ID NO: 9282 - DNA, 530 bp, Homo sapiens
aggtgcggcggcgcaactcgcgggtcttctccactggcccctgagattgccatcacctccagctcctcctctcctgaagttggcagcccctcctgggttccagcctcctgagatgccagacccactggggcagtacccacaggccctgagcctacatcaaccaccccagtgacaccccaagcctgcagcattttccacccccagccccctggtcccaccttgccttccgcccaccttcccacctgctgcagggagggccctcggctgagccttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctgaggagctgtttctgctgtgtgacaaggaggctaagggcttcatcaccaagcacgac

SEQ ID NO: 9283 - DNA, 742 bp, Homo sapiens
ataagcccagccttttgtggttcagctgggtcgcacgctggatcccaggccccttccttgaaaagcagaggccttgtaccccccagggttgccgggcgggacagtgattccagcccttcagctttcaggaccccaccttccttatcaccaggtcttctccactggcccctgagattgccatcacctccagctcctcctctcctgaagttggcagcccctcctgggttccagcctcctgagatgccagacccactggggcagtacccacaggccctgagcctacatcaaccaccccagtgacaccccaagcctgcagcattttccacccccagccccctggtcccaccttgccttccgcccaccttcccacctgctgcagggagggccctcggctgagccttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctgaggagctgtttctgctgtgtgacaaggaggctaagggcttcatcaccaagcacgacctgcagggtctccagagcgacctgcccctcacgccagagcagctggaggctgtgtttgaaagtctggaccgggctcacactggc

SEQ ID NO: 9284 - DNA, 2186 bp, Homo sapiens
gtcgggcggagcaggcggctgcttgacagctgagagccgagcgggcggcgcgggcaggtccacgggaagcctacacgcccaaggtcatgccctgaccacagctgcccttcaggaggctggcacggagccacctggggccattgggctgtttgtcaagggtggggcagcagcaacttgccactcttcctccatgagcccagccagagcctccactgggcacttagcacaagaaaaaccctgcaggagccggatccagagcgctgggattcagcaggagtgccaggagaattcaacacaggtgtgctgcctcctctcctgccaggtgtgtggctgcacaggagtcttgctgatggtggaattcaagtcaccagtggccaaagtaccctccaggtgtgaagagttgcaggtcctccgaggagccgggagctgcaaggttctgaaaaagacttcaagaaactgactaatcgcgatggctgcccctgacgggagggtagtctccagaccccagagacttggtcaggggtctggccaggggccaaaggggagtggagcctgcctgcatcccctggacagcctggagcagaaggagactcaggagcaaacgtcgggccagctagtcatgctgaggaaggcacaggagttctttcagacctgtgatgctgaaggcaagggcttcatcgccaggaaggatatgcagaggctgcataaggagctaccgctcagcctggaggaactggaggatgtgtttgatgccctggatgctgatggcaatggctatctgaccccacaggagttcactactggatttagtcacttcttcttcagccagaataacccaagtcaggaagatgcaggtgaacaggtggcccagcgccatgaagagaaggtgtatctgtccagaggggatgaggatctgggcgacatgggcgaagatgaggaagcccagttccggatgctgatggacagacttggagcccaaaaggtgttggaagatgaaagtgatgtcaagcagctctggttgcagctgaagaaggaggaacctcatttactgtccaactttgaagacttcctgaccagaatcatctcccagctccaagaagcccatgaggagaagaatgaactggagtgtgccctaaaaaggaaaattgctgcttatgatgaagaaatccagcatctctatgaggagatggaacaacaaatcaaaagtgagaaggagcagtttctcctgaaggacacagagaggtttcaagcccgcagtcaagagctggagcagaaactgttatgtaaggagcaggagctggagcagctcacccagaagcagaaaaggctggaaggtcagtgcacagccctgcatcatgacaagcatgagaccaaggctgagaataccaagctgaaactcactaaccaggagctggcccgggagctggagcggacttcctgggagctccaggatgctcagcagcagttggaaagcctccagcaagaggcctgcaaactccaccaagagaaggagatggaagtgtaccgtgtgacggagagtctacagcgtgagaaggccgggctcctcaagcagctggatttcctaaggtgcgtcggtgggcactggcctgtgctgagagcacctcccagaagcctggggtcggaaggaccagtctgagggtcatccttgcctacgtgctggaaaaacgtgcctgctgagagagtgccctcaattcccttggtccccagtgcagtgtttggaccaccaagtagccactctattatgtttggtccgtttacacatgcgcccacatccagtttattcctcctggtggggaggctctgccccactcctctgagtccctcacaggactgtgcttggtacttgatctcatgcgagcagagctgggtttaatgagcatttaatctatgctagaaatattatctcgttcattgtcagcaaaactgttaggtgagtagggcagttcattcacaggaatttactgatgggaagttgatattagaggaaagaagtaatttaccacaggcgacacagctactctctgatggggccagaatggaaatccgtaactcggctgtgttctgttcatgtttgttgaatgagtaaatgaatcacaaacagagcaccaagaaaaagctttctcagccttcaaagacccccagcaataaactcaaagtttactggt

SEQ ID NO: 9285 - DNA, 2697 bp, Homo sapiens
aaagagtcgggcggagcaggcggctgcttgacagctgagagccgagcgggcggcgcgggcaggtccacgggaagcctacacgcccaaggtcatgccctgaccacagctgcccttcaggaggctggcacggagccacctggggccattgggctgtttgtcaagggtggggcagcagcaacttgccactcttcctccatgagcccagccagagcctccactgggcacttagcacaagaaaaaccctgcaggagccggatccagagcgctgggattcagcaggagtgccaggagaattcaacacaggtgtgctgcctcctctcctgccaggtgtgtggctgcacaggagtcttgctgatggtggaattcaagtcaccagtggccaaagtaccctccaggtgtgaagagttgcaggtcctccgaggagccgggagctgcaaggttctgaaaaagacttcaagaaactgactaatcgcgatggctgcccctgacgggagggtagtctccagaccccagagacttggtcaggggtctggccaggggccaaaggggagtggagcctgcctgcatcccctggacagcctggagcagaaggagactcaggagcaaacgtcgggccagctagtcatgctgaggaaggcacaggagttctttcagacctgtgatgctgaaggcaagggcttcatcgccaggaaggatatgcagaggctgcataaggagctaccgctcagcctggaggaactggaggatgtgtttgatgccctggatgctgatggcaatggctatctgaccccacaggagttcactactggatttagtcacttcttcttcagccagaataacccaagtcaggaagatgcaggtgaacaggtggcccagcgccatgaagagaaggtgtatctgtccagaggggatgaggatctgggcgacatgggcgaagatgaggaagcccagttccggatgctgatggacagacttggagcccaaaaggtgttggaagatgaaagtgatgtcaagcagctctggttgcagctgaagaaggaggaacctcatttactgtccaactttgaagacttcctgaccagaatcatctcccagctccaagaagcccatgaggagaagaatgaactggagtgtgccctaaaaaggaaaattgctgcttatgatgaagaaatccagcatctctatgaggagatggaacaacaaatcaaaagtgagaaggagcagtttctcctgaaggacacagagaggtttcaagcccgcagtcaagagctggagcagaaactgttatgtaaggagcaggagctggagcagctcacccagaagcagaaaaggctggaaggtcagtgcacagccctgcatcatgacaagcatgagaccaaggctgagaataccaagctgaaactcactaaccaggagctggcccgggagctggagcggacttcctgggagctccaggatgctcagcagcagttggaaagcctccagcaagaggcctgcaaactccaccaagagaaggagatggaagtgtaccgtgtgacggagagtctacagcgtgagaaggccgggctcctcaagcagctggatttcctaagggaaaggaacaagcaccttcgggatgaacgggacatatgttttcagaaaaataaggcagccaaggcaaacacagctgcttccagggcaagttggaaaaagagatctggctctgtgataggcaaatatgtggacagcagagggattcttaggagccagtcagaggaggaggaggaggtgtttggcatcccaaggagaagctccctgggcctgagtggatatcccctaacagaagaggagccaggaaccggggagccagggcctgggggtccgtacccccggccgctccgcagaatcatctccgttgaagaagaccccctgccccagctcctggatggtggctttgagcaacccctgagcaaatgctcagaagaggaagaggtctctgaccagggggtacagggacaaatcccggaggccccacccttgaaactcacccccacatccccccgagggcagcctgttggaaaagaagccctgtgtaaggaggaaagctctccctctgcccctgaccggctcttcaagattgtgttcgtgggcaattccgcggtggggaagacatccttcctgaggagattctgtgaggaccggttctccccaggcatggcggccactgtgggcattgattaccgtgtgaagacgttgaatgtggacaactctcaggtggccctgcagctgtgggacacggctgggcaggagaggtaccggtgcatcacccagcagttcttcagaaaggcagatggtgtcatcgtcatgtacgatctcacagacaagcagtcgttcctgtcggtccggcggtggctgagcagcgtggaggaagctgtgggagaccgggtgcctgttcttctgctgggtaataagcttgacaacgagaaggagcgggaagtcccccggggcctcggagagcagcttgccacggagaacaatctgatcttctatgaatgcagcgcctactctggtcacaacaccaaagagtccctgctccatctggccaggttcctcaaggagcaagaagacacagtgagagaggacaccattcaggtcggccaccctgctaagaagaaatcctgctgtggctgatagggtcctacaaggactgcccccagc

SEQ ID NO: 9286 - DNA, 2228 bp, Homo sapiens
accgcttggcgcgcgcacgtcccggagggcgtccagggggcgccgcttcccgttcagctccgctgaggggctggtccagcccgcgcggctcggagcggaaagagtcgggcggagcaggcggctgcttgacagctgagagccgagcgggcggcgcgggcaggtccacgggaagcctacacgcccaaggtcatgccctgaccacagctgcccttcaggaggctggcacggagccacctggggccattgggctgtttgtcaagggtggggcagcagcaacttgccactcttcctccatgagcccagccagagcctccactgggcacttagcacaagaaaaaccctgcaggagccggatccagagcgctgggattcagcaggagtgccaggagaattcaacacaggtgtgctgcctcctctcctgccaggtgtgtggctgcacaggagtcttgctgatggtggaattcaagtcaccagtggccaaagtaccctccaggtgtgaagagttgcaggtcctccgaggagccgggagctgcaaggttctgaaaaagacttcaagaaactgactaatcgcgatggctgcccctgacgggagggtagtctccagaccccagagacttggtcaggggtctggccaggggccaaaggggagtggagcctgcctgcatcccctggacagcctggagcagaaggagactcaggagcaaacgtcgggccagctagtcatgctgaggaaggcacaggagttctttcagacctgtgatgctgaaggcaagggcttcatcgccaggaaggatatgcagaggctgcataaggagctaccgctcagcctggaggaactggaggatgtgtttgatgccctggatgctgatggcaatggctatctgaccccacaggagttcactactggatttagtcacttcttcttcagccagaataacccaagtcaggaagatgcaggtgaacaggtggcccagcgccatgaagagaaggtgtatctgtccagaggggatgaggatctgggcgacatgggcgaagatgaggaagcccagttccggatgctgatggacagacttggagcccaaaaggtgttggaagatgaaagtgatgtcaagcagctctggttgcagctgaagaaggaggaacctcatttactgtccaactttgaagacttcctgaccagaatcatctcccagctccaagaagcccatgaggagaagaatgaactggagtgtgccctaaaaaggaaaattgctgcttatgatgaagaaatccagcatctctatgaggagatggaacaacaaatcaaaagtgagaaggagcagtttctcctgaaggacacagagaggtttcaagcccgcagtcaagagctggagcagaaactgttatgtaaggagcaggagctggagcagctcacccagaagcagaaaaggctggaaggtcagtgcacagccctgcatcatgacaagcatgagaccaaggctgagaataccaagctgaaactcactaaccaggagctggcccgggagctggagcggacttcctgggagctccaggatgctcagcagcagttggaaagcctccagcaagaggcctgcaaactccaccaagagaaggagatggaagtgtaccgtgtgacggagagtctacagcgtgagaaggccgggctcctcaagcagctggatttcctaagggaaaggaacaagcaccttcgggatgaacgggacatatgttttcagaaaaataaggcagccaaggcaaacacagctgcttccagggcaagttggaaaaagagatctggctctgtgataggcaaatatgtggacagcagagggattcttaggagatggccacagagagatagaggcatcccgactcttcagtatcagacccagagagaccttgaagactgcaagcatgaaatgaaaaagatatgcaaagcggaagtgactctggagatgtaaatcagctcatcagtaaaacctttgggcctgatcatcatgaattcttgttctaaatagctgaataatgagatacaatttgggagccaaatctctgcaatagtggttggcctgttggttcctcagaatggaatggattgattgattgattcagcagacgtttactgattacctactgtgtaccagacattcttttgagttctgtaaagcctccaaaaataaattagacatgaggtcctaccattaatctccattattaaatgctcactt

SEQ ID NO: 9287 - DNA, 630 bp, Homo sapiens
agagaaggagatggaagtgtaccgtgtgacggagagtctacagcgtgagaaggccgggctcctcaagcagctggatttcctaagggaaaggaacaagcaccttcgggatgaacgggacatatgttttcagaaaaataaggcagccaaggcaaacacagctgcttccagggcaagttggaaaaagagatctggctctgtgataggcaaatatgtggacagcagagggattcttaggagatggccacagagagatagaggcatcccgactcttcagtatcagacccagagagaccttgaagactgcaagcatgaaatgaaaaagatatgcaaagcggaagtgactctggagatgtaaatcagctcatcagtaaaacctttgggcctgatcatcatgaattcttgttctaaatagctgaataatgagatacaatttgggagccaaatctctgcaatagtggttggcctgttggttcctcagaatggaatggattgattgattgattcagcagacgtttactgattacctactgtgtaccagacattcttttgagttctgtaaagcctccaaaaataaattagacatgaggtcctaccattaatctccattattaaatgctcacttaataaata

SEQ ID NO: 9288 - DNA, 2231 bp, Homo sapiens
agcgttaccatggatcctggaggtgcccgcgaacactgcttgtcgcctgggcaaccggagaggacgaagcaggacctaggtggcggcggtggtaccggctgcaatggtgtccaatcccgtgcatggcttgccctttcttccgggcacgtcctttaaggactctacgaaaacagccttccacagaagtcagacgctgagctacaggaacggctatgcaattgttcgacgtccaacagttgggataggcggagaccggctccagttcaaccagctgtcccaggctgagctggatgagttggccagtaaggcaccagtcttaacttatggccaacctaaacaagccccacctgcggattttattcctgcgcatgtggcctttgacaaaaaggtactgaaatttgatgcctatttccaagaagatgttcctatgtcaactgaggaacagtataggatccgtcaggtgaacatttactattatctagaagatgacagcatgtctgtcatagagcctgttgtagaaaattctggaatccttcaaggcaagttaataaaacgccagcggctagccaagaatgaccggggtgaccattaccattggaaagacctaaatcgaggaataaacatcacaatttatggcaaaactttccgcgttgttgactgtgaccaattcacacaggtatttttagaaagccaaggaattgagttaaatccaccagagaagatggctcttgatccttacactgaactccgaaaacagcctcttcgtaagtatgtcaccccatcagactttgatcaactcaagcaatttctcacctttgacaaacaggtccttcgattctatgcaatctgggatgatacagacagcatgtatggtgaatgtcggacctacatcattcattactatcttatggatgatacggtggaaattcgagaggtccacgaacggaatgatgggagagatcctttcccactcctaatgaaccgccagcgtgtgcccaaagttttggtggaaaatgcaaagaacttccctcagtgtgtgctagaaatctctgaccaagaagtgttggaatggtatactgctaaagacttcattgttgggaagtcactcactatccttgggagaactttcttcatttatgattgtgatccatttactcgacggtattacaaagagaagtttggaatcactgatttaccacgtattgatgtgagcaagcgggaaccacctccagtaaaacaggagttgcctccttataacggttttggactagtggaagattctgctcagaattgttttgctctcattccaaaagctccaaaaaaagacgttattaaaatgctggtgaatgataacaaggtgcttcgttatttggctgtactggaatcccccatcccagaagacaaagaccgcagatttgtcttctcttactttctagctaccgacatgatcagtatctttgagcctcctgttcgcaattctggtatcattgggggcaagtaccttggcaggactaaagttgttaaaccatactctacagtggacaaccctgtctactatggccccagtgacttcttcattggtgctgtgattgaagtgtttggtcaccggttcatcatccttgatacagacgagtatgttttgaaatacatggagagcaacgctgcccagtattcaccagaagcactcgcgtcaattcagaaccatgtccgaaagcgagaagcgcctgctccagaagcagaaagcaagcaaactgaaaaggatccaggcgtgcaggaattggaagcattaatagacacaattcagaagcaactgaaagatcactcatgcaaagacaacattcgtgaggcatttcaaatttatgacaaggaagcttcaggatatgtggacagagacatgttctttaaaatctgtgaatcgcttaacgtcccagtggatgactccttggttaaggagttaatcaggatgtgctctcatggagaaggcaaaattaactactataactttgttcgtgctttctcaaactgacctgctgatgagaaaatgcaagacaatttttgatactggaactatgctttgaaatacaccttacactcttcatagaggcatttacagggttcctgaagttttatttctgttttggttcttctttcactcctactgaagtcgaaactaaattggatctaataggatctaagattggtgccttatttagggtgataggggtatagca

SEQ ID NO: 9289 - DNA, 2020 bp, Homo sapiens
gaggacgaagcaggacctaggtggcggcggtggtaccggctgcaatggtgtccaatcccgtgcatggcttgccctttcttccgggcacgtcctttaaggactctacgaaaacagccttccacagaagtcagacgctgagctacaggaacggctatgcaattgttcgacgtccaacagttgggataggcggagaccggctccagttcaaccagctgtcccaggctgagctggatgagttggccagtactgaaatttgatgcctatttccaagaagatgttcctatgtcaactgaggaacagtataggatccgtcaggtgaacatttactattatctagaagatgacagcatgtctgtcatagagcctgttgtagaaaattctggaatccttcaaggcaagttaataaaacgccagcggctagccaagaatgaccggggtgaccattaccattggaaagacctaaatcgaggaataaacatcacaatttatggcaaaactttccgcgttgttgactgtgaccaattcacacaggtatttttagaaagccaaggaattgagttaaatccaccagagaagatggctcttgatccttacactgaactccgaaaacagcctcttcgtaagtatgtcaccccatcagactttgatcaactcaagcaatttctcacctttgacaaacaggtccttcgattctatgcaatctgggatgatacagacagcatgtatggtgaatgtcggacctacatcattcattactatcttatggatgatacggtggaaattcgagaggtccacgaacggaatgatgggagagatcctttcccactcctaatgaaccgccagcgtgtgcccaaagttttggtggaaaatgcaaagaacttccctcagtgtgtgctagaaatctctgaccaagaagtgttggaatggtatactgctaaagacttcattgttgggaagtcactcactatccttgggagaactttcttcatttatgattgtgatccatttactcgacggtattacaaagagaagtttggaatcactgatttaccacgtattgatgtgagcaagcgggaaccacctccagtaaaacaggagttgcctccttataacggttttggactagtggaagattctgctcagaattgttttgctctcattccaaaagctccaaaaaaagacgttattaaaatgctggtgaatgataacaaggtgcttcgttatttggctgtactggaatcccccatcccagaagacaaagaccgcagatttgtcttctcttactttctagctaccgacatgatcagtatctttgagcctcctgttcgcaattctggtatcattgggggcaagtaccttggcaggactaaagttgttaaaccatactctacagtggacaaccctgtctactatggccccagtgacttcttcattggtgctgtgattgaagtgtttggtcaccggttcatcatccttgatacagacgagtatgttttgaaatacatggagagcaacgctgcccagtattcaccagaagcactcgcgtcaattcagaaccatgtccgaaagcgagaagcgcctgctccagaagcagaaagcaagcaaactgaaaaggatccaggcgtgcaggaattggaagcattaatagacacaattcagaagcaactgaaagatcactcatgcaaagacaacattcgtgaggcatttcaaatttatgacaaggaagcttcaggatatgtggacagagacatgttctttaaaatctgtgaatcgcttaacgtcccagtggatgactccttggttaaggaggtcacctgcaagcggcttctcctgcctgcctttacatttcccagtcctgtctggatcccactgtgcggtctctgacctcctctgcacaacctgagctggtgtccacttcttactgacatcccatctgcttctgagaactcatgtgagccagggcaggcatctgccctagaagcttcttcttttgtctgaaagctagttgtttaaagagcat

SEQ ID NO: 9290 - DNA, 5445 bp, Homo sapiens
tttttttttttttagtttttgtagagacagcatcttgttgcccaggctggtctcgaactctggggctgaagtgattctccctcttcagcctcccagagttctgggattataggcacgagccaccatgcccagccttaatgttgaaaacagccttccacagaagtcagacgctgagctacaggaacggctatgcaattgttcgacgtccaacagttgggataggcggagaccggctccagttcaaccagctgtcccaggctgagctggatgagttggccagtaaggcaccagtcttaacttatggccaacctaaacaagccccacctgcggattttattcctgcgcatgtggcctttgacaaaaaggtactgaaatttgatgcctatttccaagaagatgttcctatgtcaactgaggaacagtataggatccgtcaggtgaacatttactattatctagaagatgacagcatgtctgtcatagagcctgttgtagaaaattctggaatccttcaaggcaagttaataaaacgccagcggctagccaagaatgaccggggtgaccattaccattggaaagacctaaatcgaggaataaacatcacaatttatggcaaaactttccgcgttgttgactgtgaccaattcacacaggtatttttagaaagccaaggaattgagttaaatccaccagagaagatggctcttgatccttacactgaactccgaaaacagcctcttcgtaagtatgtcaccccatcagactttgatcaactcaagcaatttctcacctttgacaaacaggtccttcgattctatgcaatctgggatgatacagacagcatgtatggtgaatgtcggacctacatcattcattactatcttatggatgatacggtggaaattcgagaggtccacgaacggaatgatgggagagatcctttcccactcctaatgaaccgccagcgtgtgcccaaagttttggtggaaaatgcaaagaacttccctcagtgtgtgctagaaatctctgaccaagaagtgttggaatggtatactgctaaagacttcattgttgggaagtcactcactatccttgggagaactttcttcatttatgattgtgatccatttactcgacggtattacaaagagaagtttggaatcactgatttaccacgtattgatgtgagcaagcgggaaccacctccagtaaaacaggagttgcctccttataacggttttggactagtggaagattctgctcagaattgttttgctctcattccaaaagctccaaaaaaagacgttattaaaatgctggtgaatgataacaaggtgcttcgttatttggctgtactggaatcccccatcccagaagacaaagaccgcagatttgtcttctcttactttctagctaccgacatgatcagtatctttgagcctcctgttcgcaattctggtatcattgggggcaagtaccttggcaggactaaagttgttaaaccatactctacagtggacaaccctgtctactatggccccagtgacttcttcattggtgctgtgattgaagtgtttggtcaccggttcatcatccttgatacagacgagtatgttttgaaatacatggagagcaacgctgcccagtattcaccagaagcactcgcgtcaattcagaaccatgtccgaaagcgagaagcgcctgctccagaagcagaaagcaagcaaactgaaaaggatccaggcgtgcaggaattggaagcattaatagacacaattcagaagcaactgaaagatcactcatgcaaagacaacattcgtgaggcatttcaaatttatgacaaggaagcttcaggatatgtggacagagacatgttctttaaaatctgtgaatcgcttaacgtcccagtggatgactccttggttaaggagttaatcaggatgtgctctcatggagaaggcaaaattaactactataactttgttcgtgctttctcaaactgacctgctgatgagaaaatgcaagacaatttttgatactggaactatgctttgaaatacaccttacactcttcatagaggcatttacagggttcctgaagttttatttctgttttggttcttctttcactcctactgaagtcgaaactaaattggatctaataggatctaagattggtgccttatttagggtgataggggtatagcaatgtctaattttgtgtgtcaaattgacttggccacagggggcccaaatatttcctttctttctttttaaaaaaataaatttttttagagatgggatctcactctgtcatacaggctggagtgtggtggcactatcctagttctatgaagcctcagactcctgggctcaagtgatcctcccacttcaacctccccagtagctgggacaacaggctcaagccaccatgcccagctaatttttaaaattattttgtagagacaaggtcttgctaggttgcctgaacttgtctcaaactcatgagctccagaaattctcccacctcagcctccaaaagtgctgggattataggcatgagccactgtgcccagcctcagatatttcattattctgggggtttctctgaaggtatttttcgatgagataaacatttgaatcagaagactaagtaaaacagatagtcctccctaatgtgggtgggcctcctccaatcatttgaagacatgagtagaataaaaaggctgacctttccccaggtaagagaattcctcctgcctgactggcttcaaattggaacatcagccttttcttgccttcagacacaaatggaaacatcagctgttggtctggagcctgctgaccttcagactggacctaaaccatcagctctcctaagtcataggcctttggattcagactggaattatacctttagctctcctgggtctccagcttgccaatttaccctgcagatcttgggacttgtaagccttcataattgtgtgagcaatttcttataactctctctttctctctctctacatatatatatatatatatattttatatgtacacattcatacacacacacgcttatatgtatacatatagtatgtatatgtgtatatatattatgtatatacatatatgtgcacacatctctactaaaaatagaaaaattagccaggtgtggtggcgtgtgcctgtagtcccagccactcgggaggcttaaatgggagaatcacttgaaccctggaggcagaggttgcagtgagccaagaccacgccactgcactccatccagcctgggtgacagagcaagactccatctcaaaaaaaaaaaggttagaaaaatgctgcttttagagagcctggccttgagagaggaaggaaagactagttgcagttactattctctggtgagctctgactggctttttacaaacagggcttctctttggttgaagtcagccactaagttcatctttaaacatgctatctcaaattccccgaagccacccaaaatgtggtatgaatgaggatagagttacacagaattcagactgctttgccctctcagaacttctagggaacttcccttggtgtttccttccctaacgagctcagccacttgtaaccagcttattgaaagggctgtgaatgtattatgttgattccttttctgttccaggttattatcttgggaataacccatgttttgttttgttttaccctcagtcgctcataactatttaaaacagtatctctttcaagtacagatgctcctctacttatggggctatgtctcaataaactcacgtaagtaaaaaatatcacaagttgaaaacacatttaataaccctgataagcccattgtaaagtaggcaaataagttggaccattgaaagttggggactatctgtattttagaagttttttcagcttaaaaattaccaagctctatcctacttggcccagctcagtccttcccccaggcttagaagcctgtggtaaagagtgtgtgtatactggggtgatgatagtggtttcttcttactcccttctttctgtcttctgctccctttgttcctattcagccatgctgctgtttctagcccatgtaggctctgggaaaggttaagcgggtagaaaccagagaaaaagggcaaagtcttatttctgtggctagtaatgtcgtaatgtggggccaggtctgagtgacatgtgccgaaaggctgactctttctcccagagcaccttttctctctttttggattcagggggtacatgtgcaggtttgttacatgagtatattgcacccaggtagtgagcatagtgcccagtaagtagtttttccacacataccccctccttcccttcccactctggtagtccccagtgtctattgttcccatcattatgtctatgtgtattcaatgtttagctcccacttagaagtaagaacatgcaatatttggtttcctattcctgcatcaattcactttaggataatggcctccagctgcatccatgttgctgcagaatacatgatttcattttttatggctgcgtagtattccatggtgtagatatacttcatttaaaaaatctaatccaccattgattggcacctaggttgattccatgtcctttgctcagagccccgttttggtgagttcttagaactctttccaaccggaaactgcccagtgcaccactctcagatggacgggacccagtctgtacctgatcaccccggctctaatggtatggtctccaaggctccttctgatcttcccaggaggccctttcaggctgacacaccttccagggtgtgcactctcgccatgttctcacccagatggctctcttggctgtgtaattaggcagctcaatccctttcctttagactgtttcaggggagaaccaggtaccccaaatcttatgctctccaaactccaggggacagacacatgtcaaaccctgagtcttttaaagtataccctcacttagcttgcagacccaaggcactccagcccctttcaagaagcttgcactttctgatattttctccatcactcttgcctcctgtggtagaggagctttgggctactccttaacaaatcattcatggatcggcagcaaatctgcaacatatggatatatttgccaatttttgtcctcagctttgggtctcagccaaaatggagatttaggaaagtctcatttagcatcctctagcctgcttttggctgttttgttttgtttttgtgtttgttttttagagacagggtcttactctgttgccagactggaatgcggtggtgtgaccatagctcactgcagcctcaaactcctgggctcatgcaatcctcctgcctcagccttctgagtagctaggcctgtagtctcagagggaactgtcttcaataaagttggcactgtccacatacactcctt

SEQ ID NO: 9291 - DNA, 3251 bp, Homo sapiens
aacgtgggggccaaacaacacggccgggaggcgccgctgcctgccgggccctctcttctgggaccctggattttcggacactgagcgccatggccctgcctctgctgccgggcaacagcttcaaccgcaacgtgggaaaggagaagtttcacaaatcccaacattggggcttttgcaacaatgttatgatgttggtgagtgatgaaaagcctggaataggtggagaaccacttctggggcaaaagataaagcctaaatgtagcatatatcctaaaggagatggaagtgatgtaccatcatgggtagcctttgataaacaggtattatcttttgatgcctatttggaagaggaagtacttgataaaagccaaaccaactacagaataagatactataaaatctacttctaccctgaagatgacacaattcaagtaaatgaaccagaggtgaaaaatagtggattacttcaagggacttctatccggcgtcatcggattactcttccgcctcctgatgaggatcagttttatactgtgtatcattttaatgtcggcacagaggttgtcttctatggccggacattcaagatttatgactgtgatgcattcacaagaaactttttgaggaaaataggggtcaaagtgaatcccccagtgcaatgtccagaagatccttacatgaagattcggagagaggttgtagaacacgtagagcccttacgtccctacgaatccctcgacaccctgaaacagttcctccagtatcatggcaagattttgtgtttcttctgcctgtgggatgactcagtctcaatgtttggagaccgtagagaactcatcctgcattacttcttgtgtgatgatactattgaaatcaaagaattgcttccacacagctcaggccgagatgctctaaaaatgttcctccggaggagtaagctacccaagaattgcccacctagagtctatcaaccaggccagataacagatcgagcagttctcaattcatatggtgactttataaagaaccaagcggatggctacctgttcgatagatataagctaggaaaagtagaccaagagttttacaaagatagtgacctgtccctaggagtcaccatcaatgtgtggggaagaaaagtgctcctttatgactgtgatgaatttacgaagtcttattataagtctaaatatggaattgagaactttacctcagtttcatgcaagcctccttctcctcctccaaaaatagaaaggaaatttccaccttacaacggttttggttctgaagaggattctctccgtaactgcatagacctcaagcccacacctcatcggaggaacttcaagaagtttatggaaaaagacagctatggctccaaaagcaatatactccgtttttttgcaaaactagtcacagacaaatgtgttgacttggacaggatgtttgttatttcatattatctcggtgatgacaccatttcagtgtttgaacctatagagaggaattcaggaattgctggtgggatgttcttgaaaagaagtcgcgttaagaagcctggacaagaagtctttaaaagtgaactatctgaatatatcaaggccgaggagctgtacattggagtcacggtgaatgtgaatggttacctatttcgtttgctcaatgctgatgagtataccttaaactacatggagcagaatacagataagtatcctttcagtaacctcaaacttgccctacaaaagctgaagcaagaagaaggaaaatccagagagctcaagcaggtatttaaagctgctgactctaagcacacaaatatggtggattataatacattcagagacatattgatgtctttgactgttggaaaccttgcagagcaagaatttgtaaccattgcacgtcactaccgtgtgcctgagggcacatgttcagatatggatttcttaatcgcactggcccacgaaaagttcaagaaaaatatgtttgagaatttcgacactttcatttattcctgtgtgtatgaagatcgagaaaaaaaaaatgtattacccaccaaagacattaaaaggctgtgcaaatcctccagattacctttgagtgatgatcttctagaatccttattgtcaaggtttgaagacagtgaaaaacaaatagattataagtcatttttctctgccctgaactggagaaagaatccagtgcctgaattgcaaccagcatcataccttaaagagagatgtgaagatgtttggcttggtatgccatcacctattcctgcgaaatacattgactactggacctttttgaaggacgcgtttggcttagaggaggaataaccatgccagttttggtcaattctctatgatttacttctctcattttgccacatttactttagtagatataatttcattaaaaacaaaaaagaaacaaggtttatattaaatggaaatccataaaccacaattaatcctattttgtcatgttagttttacagaacatcatgttacattgccgacgtactgttactatttaaaatgccatcttaaaacatgttgaatatttttattatatgtatggtttattaataccaaaaaatcttctgataatttttgatccaacataatttgattcattactatatgaacagaaaatgacttttgaaggttatacatgacaatacaaaatcaaattatatcacagcaataagttgtgattctattaaacatttttgaaacctttttgacacgtttattacttacataattaagttttgtagcaacccacctcatcaaaataattcttaaacctctctagagtaaatatatttatcttttgaacttagtaaagctatgggaagaaaaagaacctccaacacacacacacacacacacacacacgcacgtgcacacacactggaaacatatgcagtatttatatttgtaatgcccttttttctatctaaagtcagcttgttagcttaggaatatatgcatgtgtgtataattatagtttgaccaaaactttattatgtctaaaatatttacaaatgtgaaagctgaagattttgagatttttgttttttttttggtttgttttacacacacatcccacgcgccccaccctagaggtttaaatattcagaaactacaacatttttcccctgcatttttctagttctatttttatttttcttcagcagaactcttgtcatgtagtgtacatttgattaaaacccatagccatgt

SEQ ID NO: 9292 - DNA, 1484 bp, Homo sapiens
atctcactcatttgttcatatattggtctctgaggtcccttctaggctctgacaactggaaactctgaaaatagacatattgatgtctttgactgttggaaaccttgcagagcaagaatttgtaaccattgcacgtcactaccgtgtgcctgagggcacatgttcagatatggatttcttaatcgcactggcccacgaaaagttcaagaaaaatatgtttgagaatttcgacactttcatttattcctgtgtgtatgaagatcgagaaaaaaaaaatgtattacccaccaaagacattaaaaggctgtgcaaatcctccagattacctttgagtgatgatcttctagaatccttattgtcaaggtttgaagacagtgaaaaacaaatagattataagtcatttttctctgccctgaactggagaaagaatccagtgcctgaattgcaaccagcatcataccttaaagagagatgtgaagatgtttggcttggtatgccatcacctattcctgcgaaatacattgactactggacctttttgaaggacgcgtttggcttagaggaggaataaccatgccagttttggtcaattctctatgatttacttctctcattttgccacatttactttagtagatataatttcattaaaaacaaaaaagaaacaaggtttatattaaatggaaatccataaaccacaattaatcctattttgtcatgttagttttacagaacatcatgttacattgccgacgtactgttactatttaaaatgccatcttaaaacatgttgaatatttttattatatgtatggtttattaataccaaaaaatcttctgataatttttgatccaacataatttgattcattactatatgaacagaaaatgacttttgaaggttatacatgacaatacaaaatcaaattatatcacagcaataagttgtgattctattaaacatttttgaaacctttttgacacgtttattacttacataattaagttttgtagcaacccacctcatcaaaataattcttaaacctctctagagtaaatatatttatcttttgaacttagtaaagctatgggaagaaaaagaacctccaacacacacacacacacacacacacacgcacgtgcacacacactggaaacatatgcagtatttatatttgtaatgcccttttttctatctaaagtcagcttgttagcttaggaatatatgcatgtgtgtataattatagtttgaccaaaactttattatgtctaaaatatttacaaatgtgaaagctgaagattttgagatttttgttttttttttggtttgttttacacacacatcccacgcgccccaccctagaggtttaaatattcagaaactacaacatttttcccctgcatttttctagttctatttttatttttcttcagcagaactcttgtcatgtagtgtacatttgattaaaacccatagccatgta

SEQ ID NO: 9293 - DNA, 1430 bp, Homo sapiens
aacgtgggggccaaacaacacggccgggaggcgccgctgcctgccgggccctctcttctgggaccctggattttcggacactgagcgccatggccctgcctctgctgccgggcaacagcttcaaccgcaacgtgggaaaggagaagtttcacaaatcccaacattggggcttttgcaacaatgttatgatgttggtgagtgatgaaaagcctggaataggtggagaaccacttctggggcaaaagataaagcctaaatgtagcatatatcctaaaggagatggaagtgatgtaccatcatgggtagcctttgataaacaggtattatcttttgatgcctatttggaagaggaagtacttgataaaagccaaaccaactacagaataagatactataaaatctacttctaccctgaagatgacacaattcaagtaaatgaaccagaggtgaaaaatagtggattacttcaagggacttctatccggcgtcatcggattactcttccgcctcctgatgaggatcagttttatactgtgtatcattttaatgtcggcacagaggttgtcttctatggccggacattcaagatttatgactgtgatgcattcacaagaaactttttgaggaaaataggggtcaaagtgaatcccccagtgcaatgtccagaagatccttacatgaagattcggagagaggttgtagaacacgtagagcccttacgtccctacgaatccctcgacaccctgaaacagttcctccagtatcatggcaagattttgtgtttcttctgcctgtgggatgactcagtctcaatgtttggagaccgtagagaactcatcctgcattacttcttgtgtgatgatactattgaaatcaaagaattgcttccacacagctcaggccgagatgctctaaaaatgttcctccggaggagtaagctacccaagaattgcccacctagagtctatcaaccaggccagataacagatcgagcagttctcaattcatatggtgactttataaagaaccaagcggatggctacctgttcgatagatataagctaggaaaagtagaccaagagttttacaaagatagtgacctgtccctaggagtcaccatcaatgtgtggggaagaaaagtgctcctttatgactgtgatgaatttacgaagtcttattataagtctaaatatggaattgagaactttacctcagtttcatgcaagcctccttctcctcctccaaaaatagaaaggaaatttccaccttacaacggttttggttctgaagaggattctctccgtaactgcatagacctcaagcccacacctcatcggaggaacttcaagaagtttatggaaaaagacagctatggctccaaaagcaatatactctttttttgcaaaactagtcacagacaaatgtgttga

SEQ ID NO: 9294 - DNA, 2464 bp, Homo sapiens
gggggccaaacaacacggccgggaggcgccgctgcctgccgggccctctcttctgggaccctggattttcggacactgagcgccatggccctgcctctgctgccgggcaacagcttcaaccgcaacgtgggaaaggagaagtttcacaaatcccaacattggggcttttgcaacaatgttatgatgttggtgagtgatgaaaagcctggaataggtggagaaccacttctggggcaaaagataaagcctaaatgtagcatatatcctaaaggagatggaagtgatgtaccatcatgggtagcctttgataaacaggtattatcttttgatgcctatttggaagaggaagtacttgataaaagccaaaccaactacagaataagatactataaaatctacttctaccctgaagatgacacaattcaagtaaatgaaccagaggtgaaaaatagtggattacttcaagggacttctatccggcgtcatcggattactcttccgcctcctgatgaggatcagttttatactgtgtatcattttaatgtcggcacagaggttgtcttctatggccggacattcaagatttatgactgtgatgcattcacaagaaactttttgaggaaaataggggtcaaagtgaatcccccagtgcaatgtccagaagatccttacatgaagattcggagagaggttgtagaacacgtagagcccttacgtccctacgaatccctcgacaccctgaaacagttcctccagtatcatggcaagattttgtgtttcttctgcctgtgggatgactcagtctcaatgtttggagaccgtagagaactcatcctgcattacttcttgtgtgatgatactattgaaatcaaagaattgcttccacacagctcaggccgagatgctctaaaaatgttcctccggaggagtaagctacccaagaattgcccacctagagtctatcaaccaggccagataacagatcgagcagttctcaattcatatggtgactttataaagaaccaagcggatggctacctgttcgatagatataagctaggaaaagtagaccaagagttttacaaagatagtgacctgtccctaggagtcaccatcaatgtgtggggaagaaaagtgctcctttatgactgtgatgaatttacgaagtcttattataagtctaaatatggaattgagaactttacctcagtttcatgcaagcctccttctcctcctccaaaaatagaaaggaaatttccaccttacaacggttttggttctgaagaggattctctccgtaactgcatagacctcaagcccacacctcatcggaggaacttcaagaagtttatggaaaaagacagctatggctccaaaagcaatatactccgtttttttgcaaaactagtcacagacaaatgtgttgacttggacaggatgtttgttatttcatattatctcggtgatgacaccatttcagtgtttgaacctatagagaggaattcaggaattgctggtgggatgttcttgaaaagaagtcgcgttaagaagcctggacaagaagtctttaaaagtgaactatctgaatatatcaaggccgaggagctgtacattggagtcacggtgaatgtgaatggttacctatttcgtttgctcaatgctgatgagtataccttaaactacatggagcagaatacagataagtatcctttcagtaacctcaaacttgccctacaaaagctgaagcaagaagaaggaaaatccagagagctcaagcaggtatttaaagctgctgactctaagcacacaaatatggtggattataatacattcagagacatattgatgtctttgactgttggaaaccttgcagagcaagaatttgtaaccattgcacgtcactaccgtgtgcctgagggcacatgttcagatatggatttcttaatcgcactggcccacgaaaagttcaagaaaaatatgtttgagaatttcgacactttcatttattcctgtgtgtatgaagatcgagaaaaaaaaaatgtattacccaccaaagacattaaaaggctgtgcaaatcctccagattacctttgagtgatgatcttctagaatccttattgtcaaggtttgaagacagtgaaaaacaaatagattataagtcatttttctctgccctgaactggagaaagaatccagtgcctgaattgcaaccagcatcataccttaaagagagatgtgaagatgtttggcttggtatgccatcacctattcctgcgaaatacattgactactggacctttttgaaggacgcgtttggcttagaggaggaataaccatgccagttttggtcaattctctatgatttacttctctcattttgccacatttactttagtagatataatttcattaaaaacaaaaaagaaacaaggtttatattaaatggaaatccataaaccacaa

SEQ ID NO: 9295 - DNA, 2274 bp, Homo sapiens
aaacaacacggccgggaggcgccgctgcctgccgggccctctcttctgggaccctggattttcggacactgagcgccatggccctgcctctgctgccgggcaacagcttcaaccgcaacgtgagaaaggagatggaagtgatgtaccatcatgggtagcctttgataaacaggtattatcttttgatgcctatttggaagaggaagtacttgataaaagccaaaccaactacagaataagatactataaaatctacttctaccctgaagatgacacaattcaagtaaatgaaccagaggtgaaaaatagtggattacttcaagggacttctatccggcgtcatcggattactcttccgcctcctgatgaggatcagttttatactgtgtatcattttaatgtcggcacagaggttgtcttctatggccggacattcaagatttatgactgtgatgcattcacaagaaactttttgaggaaaataggggtcaaagtgaatcccccagtgcaatgtccagaagatccttacatgaagattcggagagaggttgtagaacacgtagagcccttacgtccctacgaatccctcgacaccctgaaacagttcctccagtatcatggcaagattttgtgtttcttctgcctgtgggatgactcagtctcaatgtttggagaccgtagagaactcatcctgcattacttcttgtgtgatgatactattgaaatcaaagaattgcttccacacagctcaggccgagatgctctaaaaatgttcctccggaggagtaagctacccaagaattgcccacctagagtctatcaaccaggccagataacagatcgagcagttctcaattcatatggtgactttataaagaaccaagcggatggctacctgttcgatagatataagctaggaaaagtagaccaagagttttacaaagatagtgacctgtccctaggagtcaccatcaatgtgtggggaagaaaagtgctcctttatgactgtgatgaatttacgaagtcttattataagtctaaatatggaattgagaactttacctcagtttcatgcaagcctccttctcctcctccaaaaatagaaaggaaatttccaccttacaacggttttggttctgaagaggattctctccgtaactgcatagacctcaagcccacacctcatcggaggaacttcaagaagtttatggaaaaagacagctatggctccaaaagcaatatactccgtttttttgcaaaactagtcacagacaaatgtgttgacttggacaggatgtttgttatttcatattatctcggtgatgacaccatttcagtgtttgaacctatagagaggaattcaggaattgctggtgggatgttcttgaaaagaagtcgcgttaagaagcctggacaagaagtctttaaaagtgaactatctgaatatatcaaggccgaggagctgtacattggagtcacggtgaatgtgaatggttacctatttcgtttgctcaatgctgatgagtataccttaaactacatggagcagaatacagataagtatcctttcagtaacctcaaacttgccctacaaaagctgaagcaagaagaaggaaaatccagagagctcaagcaggtatttaaagctgctgactctaagcacacaaatatggtggattataatacattcagagacatattgatgtctttgactgttggaaaccttgcagagcaagaatttgtaaccattgcacgtcactaccgtgtgcctgagggcacatgttcagatatggatttcttaatcgcactggcccacgaaaagttcaagaaaaatatgtttgagaatttcgacactttcatttattcctgtgtgtatgaagatcgagaaaaaaaaaatgtattacccaccaaagacattaaaaggctgtgcaaatcctccagattacctttgagtgatgatcttctagaatccttattgtcaaggtttgaagacagtgaaaaacaaatagattataagtcatttttctctgccctgaactggagaaagaatccagtgcctgaattgcaaccagcatcataccttaaagagagatgtgaagatgtttggcttggtatgccatcacctattcctgcgaaatacattgactactggacctttttgaaggacgcgtttggcttagaggaggaataaccatgccagttttggtcaattctctatgatttacttctctcattttgccacatttactttagtagatataatttcattaaaaa

SEQ ID NO: 9296 - DNA, 2259 bp, Homo sapiens
cccagcctgtcccgggccgcgagcgcttccagtcgggttacttctgggggacaagaaaggcaccgtctgaacggtcgagacgctttttcccgctacggttttccccggagctgacaggggcagcaaggtcggagttgatccgagggtccctgcctggtcccggggggacggtcagcctcccgcccggagccgcggggagaggaagcaggtcggggtctccgggacgcgcagacacccagacaccggcggcctcctcccaccaggctggcagtcgctgagccctggcgcctccttaaagccgcagctccgccccgaccgccccgcccgccagtccgtcctcagaccctcccaaccgccgggtccccgccgcctcggcggagtgttgtagagcctcgagcctgcgaggagcgcgccgcccgccagctccctgcgtcccgtcccgcgtccccgcgttcccgcgtcctgcgatccgccgccatggccagtgaggagctggcgtgcaagctggagcgccggctgcggcgcgaggaggccgaggagagtggcccccagctggctcccctcggcgccccagccccggagcccaagcccgagcccgagcctcccgcccgtgcgcccacggccagcgccgacgcggagctgagcgcccagctgagccggcggctggacatcaacgagggcgctgcgcggccccggcgctgcagggtcttcaacccctacacggagttcccggagttcagccgccgcctcatcaaggacctggagagcatgttcaaactgtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccatagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatccccaaagtcatggccatactcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcctttctatctta

SEQ ID NO: 9297 - DNA, 1156 bp, Homo sapiens
gctaagtgcaggcggataccccggccttggcggctgcttgcctttctccgtactgtccctgtgaaggccaagatctgtaacgctgacagtccccagacatacgatgggagagttgcagtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccatagtaacacacattagagaaaggacagaggtctgctccttcctgccacctttctcctggcccctta

SEQ ID NO: 9298 - DNA, 1817 bp, Homo sapiens
actctacagcgtgtatccgtggctgtaacgtgagctggtggagcagtcaaggttagacaggaaattttaattaccctggacttatctggaggcctctttcaaagggaggcaatgagggcagccacttaaaggcaggaccccaatgcaacatcttaaaatgcagccgcaaggtttttgcagcatactaaaagcttgtgttttaattccccaaagagagggtgggaagaggaacatttggctatgggaaagttgtctttttcttaagaatctgaaacggtgatgtcatggatgtcctgccagtgccagagtcccgcgttaccaagacaccagtgaaacccaaaaaggtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccatagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatccccaaagtcatggccatactcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcctttc

SEQ ID NO: 9299 - DNA, 1538 bp, Homo sapiens
aggaattacatgtttcggagactaacgagtgtcctttcatcccggtcatgcattcctttgaccctgcaggtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccaccaccccgtgccagctcccgtgccagccttcattcctcccagtgtccaagcccctccaggagggtcctggggtgggccagatgcctgcccacctctgtctcctgcctctgctcctctgcccttcttatagccagaacttgtatcttctcagcaaccttcactttgtccttgtccctttaccattccccatcaaagagtagtctgctatatcaatttgtgtagatatgtctgtctttttgggtcctcagagaaaatgcccattttctcggagaattctctgcactcctctctgcttcacattcaacttccctgttctcatctttggtaggattctgccagttgcttttgcatcttctgttcctgggtaatggtgggtcttaatggaggctgggtggaccactgcccgtccactcttcaacaggaggaacagcatgccaccatagtaacacacattagagaaaggacagaggtctgctccttcctgccacctttctcctggccccttagcattcccccagtccctccctcttcaccttgctccgtctatgtcttcccagctcagccttttccccactcttaaatactgtactacttcactgtaagaacgaaagaatagttaggataccaatgagtaaaagggttcctgttcactctgactctgtgcaaattgtattacagtagaccgctgacgttcccaagtgacagatccagggcctttcaaacatccccaaagtcatggccatactcaccattagccagtttctaacatctgtttcagggtatccagctgtagatgttcttatcccccatacttgtgagttcttggggttgctcacaaatactaggggtttttgttgtatttttaacaaatatatcctaatgtcatatttattctcttttgtaactgctgtctttacaataaagaaatcatctgcc

SEQ ID NO: 9300 - DNA, 1003 bp, Homo sapiens
acttctgggggacaagaaaggcaccgtctgaacggtcgagacgctttttcccgctacggttttccccggagctgacaggggcagcaaggtcggagttgatccgagggtccctgcctggtcccggggggacggtcagcctcccgcccggagccgcggggagaggaagcaggtcggggtctccgggacgcgcagacacccagacaccggcggcctcctcccaccaggctggcagtcgctgagccctggcgcctccttaaagccgcagctccgccccgaccgccccgcccgccagtccgtcctcagaccctcccaaccgccgggtccccgccgcctcggcggagtgttgtagagcctcgagcctgcgaggagcgcgccgcccgccagctccctgcgtcccgtcccgcgtccccgcgttcccgcgtcctgcgatccgccgcctcatcaaggacctggagagcatgttcaaactgtatgacgctgggcgggatggcttcatcgacctgatggagctgaagctgatgatggagaagctgggggccccccagacccacctgggcctgaagagcatgatcaaggaggtggatgaggacttcgatggcaagctcagcttccgggagttcctgctcattttccacaaggccgcggcaggggagctgcaggaggacagtgggctgatggcgctggcaaagctttctgagatcgatgtggccctggagggtgtcaaaggtgccaagaacttctttgaagccaaggtccaagccttgtcatcggccagtaagtttgaagcagagttgaaagctgagcaagatgagcggaagcgggaggaggaggagaggcggctccgccaggcagccttccagaaactcaaggccaacttcaatacatagtcctgctgaccttgccctctgcccacagctgtgcctcacagatgccccgagaagagatgactaggcatcttcatcactgctgtcggtcccctccctgagccagcatctccatccac

SEQ ID NO: 9301 - DNA, 5438 bp, Homo sapiens
gggtcgtccgtcgcgccgcccggcgaggagtgggctggcggcggtagctgtcgcccgcttggttgcgtgaccgcggggtccgcgtccgctccctccacccttcgcccttcgcccttcgcctcgttccggcctccgcggcccagcaacggccgtcatggtgccgtcggcgctccctgcgcggccccgctgagcctcggtgcggcggcgagcgcggtcgagatcgccatgcctacccgagtatgctgctgctgttccgctttgcgtcctcgctacaaacgcctggtggacaacatattccctgaagatccaaaagatggccttgtgaaaactgatatggagaaattgacattttatgcagtatctgctccagagaaactggatcgaattggttcttacctggcagaaaggttgagcagggatgttgtcagacatcgttctgggtatgttttgattgctatggaggcactggaccaacttctcatggcttgccattctcaaagcattaagccatttgtagaaagctttcttcatatggtggcaaagctgctggaatcgggggaaccaaagcttcaagttcttggaacaaattcttttgtcaaatttgcaaatattgaagaagacacaccatcctatcacagacgttatgacttttttgtgtctcgattcagtgccatgtgccattcctgtcatagtgatccagaaatacgaacagagatacgaattgctggaattagaggtattcaaggtgtggttcgcaaaacagtcaacgatgaacttcgggccaccatttgggaacctcagcatatggataagattgttccatccctcctgtttaacatgcaaaagatagaagaagttgacagtcgcataggccctccttcttctccttctgcaactgacaaagaagagaatcctgctgtgctggctgaaaactgtttcagagaactgctgggtcgagcaacttttgggaatatgaataatgctgttagaccagtttttgcgcatttagatcatcacaaactgtgggatcccaatgaatttgcagttcactgctttaaaattataatgtattccattcaggctcagtattctcaccatgtgatccaggagattctaggacaccttgatgctcgtaaaaaagatgctccccgggttcgagcaggtattattcaggttctgttagaggctgttgccattgctgctaaaggttccataggtccgacagtgctggaagtcttcaatacccttttgaaacatctgcgtctcagcgttgaattcgaagcaaatgatttacaggggggatctgtaggcagtgtcaacttaaatacaagttccaaagacaatgatgagaagattgtgcagaatgctatcatccaaacaataggattttttggaagtaacctaccagattatcagaggtcagaaatcatgatgttcattatggggaaagtacctgtctttggaacatctacccatactttggatatcagtcaactaggggatttgggaaccaggagaattcagataatgttgctgagatctttgcttatggtgacctctggatataaagcgaagacgattgttactgcactgccagggtctttcctggatcctttgttatcaccatctctcatggaggactacgaactgagacagttggtcttggaagtaatgcataatctcatggatcgtcatgacaatagggcaaagcttcgagggatcagaataataccggatgtagctgacctaaagataaaaagagaaaaaatttgcagacaagacacaagtttcatgaaaaagaatgggcaacagctgtatcggcacatatatttgggttgtaaagaggaagacaacgttcagaaaaactatgaactactttatacttctcttgctcttataactattgaactggctaatgaagaagtagttattgatctcattcgactggccattgctttacaggacagtgcaattatcaatgaggataatttgccaatgttccatcgttgtggaatcatggcactggttgcagcatacctcaactttgtaagtcagatgatagctgtccctgcattttgccagcatgttagcaaggttattgaaattcgaactatggaagccccttattttctaccagagcatatcttcagagataagtgcatgcttccaaaatctttagagaagcatgaaaaagatttgtactttctgaccaacaagattgcagagtcgctaggtggaagtggatatagtgttgagagattgtcagttccgtatgtaccacaagtaacagatgaagatcgactttctagaagaaaaagcattgtggacaccgtatccattcaggtggatattttatccaacaatgttccttctgatgatgtggttagtaacactgaagaaatcacttttgaagcattgaagaaagcaattgataccagtggaatggaagaacaggaaaaggaaaagaggcgtcttgtgatagagaaatttcagaaagcaccttttgaagaaatagcagcacagtgtgaatccaaagcaaatttgcttcatgatagacttgcccaaatattggaactcaccatacgtcctcctcccagtccatcaggaacactgaccattacttctgggcatgcccaataccaatctgtcccagtctatgagatgaagtttccagatctgtgtgtgtactgatcggcgcatgaagacctcaggatatgatttgtaaagcctaaaaattaaggccaagctgagctttcagggtttacttaatgtgtattaacatacttcttgaaaataatgatggaacatatctttaaccaaatgtttggcataccatattagaagttttggagctatatataatttcgagtactttcaaagatagatttatgccatgttaatttgctttgaggttcctgttgcctttttaagttgaacatgttttggtttcactttattccactgttaagtagtatgttttaaacttttcacaaatgtaatgttttttaaaaagtaagccttcagaggattgaaactgtataaattgtttatctcttaaacatctacacagccgcttagatgtagaatttttgttgttgttttctgcaaaggcagatacatttaaatatattcctagtcctgggactgcaaaactgttcggtggctttttgtccccatgctttagataagctgggataggcaccttgctattcagttactataataatatgtgataggcattcctcatcttcttcacaataataggacatctgttgaatagcattcctcgaatataaccctaaaaacgccatactttaaattgtctggttcttgtaatattgtgtttcctgccaagagtttgaccattctgcttgagaagtgtagagcttactcttggagtaccaaactgtgcaatatttttacatcataagatgtattagtttacaggctgtgctttgaaattatagtagtattttgctgtggctccattaattaaatgagatatatatttagtgcagaaaaaagacatttaaaacagctattagttcacctgtgaagagtctgtacattttgatttctattaagagcacatttatttacatttgtatattattttaaatcctcatagtcaaaaaattctccagatggacttttaatttgtaagatttgaactgtgacttgtatacatctgtttagaatcaattatatttgaaaagctgcctgtgttttaacagtcaagtgtgctaaagtttgtcaatttaagctgcttttgatttcagctaccaagatcacaggtgcactctacacataacactgacagacccataacattacatacatcttagtgaattctatcacatggtaaaatgaacagctttctttgtaactcataaaattctcttaggacatttttataaagtcacctgtttatagttctatcttttcagattccatttctttttacataaaacagcatacatatcaaaaactgtagcctagaatacagtttaatttttggcttttgtttttgtttaaaaaattgcagtgaagaatgggatgtttgtgtttatggctatttgggcacctttagtagaaacagacaaaagtaaggaaacgataataggacaagcatacttgaaaatttctgaatacttaaacaaaagcgcaacatcttgaaaaccagtctagtcattgaaacctatgaaatgacactgaaagatcctgggctgcttcttaaataagtagatcagcaagacttgtttcagagtgacagtggagtcgttaccgctggaggactaaagggccctgtggcagctgtcactggaactttgcctcttgatcaggaaaaatgcttcaccagtccgtaaagccaagttgtatttttttaattgcccttttttccttctgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgttaatcattctctttttgctgtatagaattgcttatatcactctttctttcatgacattggttaacatttaaatgttcctcctgtacttgtgttgtctgtgaccgcttatagagttttattgttattggtgtttacctgaatacctatgcgtacacacacacatatttccttaatacttctgaactcattatcttttagaataataatactactacactttaccagcaattaacttctccctacccaaaatgtttttcttcctgtctgaaaatggaactaatttgtcttattcgtgcttatatctgtattaaatgcaataaagttagtttttgaaatgtaaaaattcactgtgcaattcatatgtcagcaataaaacatagattatttgtatataagttcatttttatagctattgttacatttaattaaatttattcaatatttgcttaaattaaaaa

SEQ ID NO: 9302 - DNA, 4776 bp, Homo sapiens
atgaaatctagagtatgctgctgctgttccgctttgcgtcctcgctacaaacgcctggtggacaacatattccctgaagatccaaaagatggccttgtgaaaactgatatggagaaattgacattttatgcagtatctgctccagagaaactggatcgaattggttcttacctggcagaaaggttgagcagggatgttgtcagacatcgttctgggtatgttttgattgctatggaggcactggaccaacttctcatggcttgccattctcaaagcattaagccatttgtagaaagctttcttcatatggtggcaaagctgctggaatcgggggaaccaaagcttcaagttcttggaacaaattcttttgtcaaatttgcaaatattgaagaagacacaccatcctatcacagacgttatgacttttttgtgtctcgattcagtgccatgtgccattcctgtcatagtgatccagaaatacgaacagagatacgaattgctggaattagaggtattcaaggtgtggttcgcaaaacagtcaacgatgaacttcgggccaccatttgggaacctcagcatatggataagattgttccatccctcctgtttaacatgcaaaagatagaagaagttgacagtcgcataggccctccttcttctccttctgcaactgacaaagaagagaatcctgctgtgctggctgaaaactgtttcagagaactgctgggtcgagcaacttttgggaatatgaataatgctgttagaccagtttttgcgcatttagatcatcacaaactgtgggatcccaatgaatttgcagttcactgctttaaaattataatgtattccattcaggctcagtattctcaccatgtgatccaggagattctaggacaccttgatgctcgtaaaaaagatgctccccgggttcgagcaggtattattcaggttctgttagaggctgttgccattgctgctaaaggttccataggtccgacagtgctggaagtcttcaatacccttttgaaacatctgcgtctcagcgttgaattcgaagcaaatgatttacaggggggatctgtaggcagtgtcaacttaaatacaagttccaaagacaatgatgagaagattgtgcagaatgctatcatccaaacaataggattttttggaagtaacctaccagattatcagaggtcagaaatcatgatgttcattatggggaaagtacctgtctttggaacatctacccatactttggatatcagtcaactaggggatttgggaaccaggagaattcagataatgttgctgagatctttgcttatggtgacctctggatataaagcgaagacgattgttactgcactgccagggtctttcctggatcctttgttatcaccatctctcatggaggactacgaactgagacagttggtcttggaagtaatgcataatctcatggatcgtcatgacaatagggcaaagcttcgagggatcagaataataccggatgtagctgacctaaagataaaaagagaaaaaatttgcagacaagacacaagtttcatgaaaaagaatgggcaacagctgtatcggcacatatatttgggttgtaaagaggaagacaacgttcagaaaaactatgaactactttatacttctcttgctcttataactattgaactggctaatgaagaagtagttattgatctcattcgactggccattgctttacaggacagtgcaattatcaatgaggataatttgccaatgttccatcgttgtggaatcatggcactggttgcagcatacctcaactttgtaagtcagatgatagctgtccctgcattttgccagcatgttagcaaggttattgaaattcgaactatggaagccccttattttctaccagagcatatcttcagagataagtgcatgcttccaaaatctttagagaagcatgaaaaagatttgtactttctgaccaacaagattgcagagtcgctaggtggaagtggatatagtgttgagagattgtcagttccgtatgtaccacaagtaacagatgaagatcgactttctagaagaaaaagcattgtggacaccgtatccattcaggtggatattttatccaacaatgttccttctgatgatgtggttagtaacactgaagaaatcacttttgaagcattgaagaaagcaattgataccagtggaatggaagaacaggaaaaggaaaagaggcgtcttgtgatagagaaatttcagaaagcaccttttgaagaaatagcagcacagtgtgaatccaaagcaaatttgcttcatgatagacttgcccaaatattggaactcaccatacgtcctcctcccagtccatcaggaacactgaccattacttctgggcatgcccaataccaatctgtcccagtctatgagatgaagtttccagatctgtgtgtgtactgatcggcgcatgaagacctcaggatatgatttgtaaagcctaaaaattaaggccaagctgagctttcagggtttacttaatgtgtattaacatacttcttgaaaataatgatggaacatatctttaaccaaatgtttggcataccatattagaagttttggagctatatataatttcgagtactttcaaagatagatttatgccatgttaatttgctttgaggttcctgttgcctttttaagttgaacatgttttggtttcactttattccactgttaagtagtatgttttaaacttttcacaaatgtaatgttttttaaaaagtaagccttcagaggattgaaactgtataaattgtttatctcttaaacatctacacagccgcttagatgtagaatttttgttgttgttttctgcaaaggcagatacatttaaatatattcctagtcctgggactgcaaaactgttcggtggctttttgtccccatgctttagataagctgggataggcaccttgctattcagttactataataatatgtgataggcattcctcatcttcttcacaataataggacatctgttgaatagcattcctcgaatataaccctaaaaacgccatactttaaattgtctggttcttgtaatattgtgtttcctgccaagagtttgaccattctgcttgagaagtgtagagcttactcttggagtaccaaactgtgcaatatttttacatcataagatgtattagtttacaggctgtgctttgaaattatagtagtattttgctgtggctccattaattaaatgagatatatatttagtgcagaaaaaagacatttaaaacagctattagttcacctgtgaagagtctgtacattttgatttctattaagagcacatttatttacatttgtatattattttaaatcctcatagtcaaaaaattctccagatggacttttaatttgtaagatttgaactgtgacttgtatacatctgtttagaatcaattatatttgaaaagctgcctgtgttttaacagtcaagtgtgctaaagtttgtcaatttaagctgcttttgatttcagctaccaagatcacaggtgcactctacacataacactgacagacccataacattacatacatcttagtgaattctatcacatggtaaaatgaacagctttctttgtaactcataaaattctcttaggacatttttataaagtcacctgtttatagttctatcttttcagattccatttctttttacataaaacagcatacatatcaaaaactgtagcctagaatacagtttaatttttggcttttgtttttgtttaaaaaattgcagtgaagaatgggatgtttgtgtttatggctatttgggcacctttagtagaaacagacaaaagtaaggaaacgataataggacaagcatacttgaaaatttctgaatacttaaacaaaagcgcaacatcttgaaaaccagtctagtcattgaaacctatgaaatgacactgaaagatcctgggctgcttcttaaataagtagatcagcaagacttgtttcagagtgacagtggagtcgttaccgctggaggactaaagggccctgtggcagctgtcactggaactttgcctcttgatcaggaaaaatgcttcaccagtccgtaaagccaagttgtatttttttaattgcccttttttccttctgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgttaatcattctctttttgctgt

SEQ ID NO: 9303 - DNA, 4644 bp, Homo sapiens
atgccaaaaggagtatgctgctgctgttccgctttgcgtcctcgctacaaacgcctggtggacaacatattccctgaagatccaaaagatggccttgtgaaaactgatatggagaaattgacattttatgcagtatctgctccagagaaactggatcgaattggttcttacctggcagaaaggttgagcagggatgttgtcagacatcgttctgggtatgttttgattgctatggaggcactggaccaacttctcatggcttgccattctcaaagcattaagccatttgtagaaagctttcttcatatggtggcaaagctgctggaatcgggggaaccaaagcttcaagttcttggaacaaattcttttgtcaaatttgcaaatattgaagaagacacaccatcctatcacagacgttatgacttttttgtgtctcgattcagtgccatgtgccattcctgtcatagtgatccagaaatacgaacagagatacgaattgctggaattagaggtattcaaggtgtggttcgcaaaacagtcaacgatgaacttcgggccaccatttgggaacctcagcatatggataagattgttccatccctcctgtttaacatgcaaaagatagaagaagttgacagtcgcataggccctccttcttctccttctgcaactgacaaagaagagaatcctgctgtgctggctgaaaactgtttcagagaactgctgggtcgagcaacttttgggaatatgaataatgctgttagaccagtttttgcgcatttagatcatcacaaactgtgggatcccaatgaatttgcagttcactgctttaaaattataatgtattccattcaggctcagtattctcaccatgtgatccaggagattctaggacaccttgatgctcgtaaaaaagatgctccccgggttcgagcaggtattattcaggttctgttagaggctgttgccattgctgctaaaggttccataggtccgacagtgctggaagtcttcaatacccttttgaaacatctgcgtctcagcgttgaattcgaagcaaatgatttacaggggggatctgtaggcagtgtcaacttaaatacaagttccaaagacaatgatgagaagattgtgcagaatgctatcatccaaacaataggattttttggaagtaacctaccagattatcagaggtcagaaatcatgatgttcattatggggaaagtacctgtctttggaacatctacccatactttggatatcagtcaactaggggatttgggaaccaggagaattcagataatgttgctgagatctttgcttatggtgacctctggatataaagcgaagacgattgttactgcactgccagggtctttcctggatcctttgttatcaccatctctcatggaggactacgaactgagacagttggtcttggaagtaatgcataatctcatggatcgtcatgacaatagggcaaagcttcgagggatcagaataataccggatgtagctgacctaaagataaaaagagaaaaaatttgcagacaagacacaagtttcatgaaaaagaatgggcaacagctgtatcggcacatatatttgggttgtaaagaggaagacaacgttcagaaaaactatgaactactttatacttctcttgctcttataactattgaactggctaatgaagaagtagttattgatctcattcgactggccattgctttacaggacagtgcaattatcaatgaggataatttgccaatgttccatcgttgtggaatcatggcactggttgcagcatacctcaactttgtaagtcagatgatagctgtccctgcattttgccacaagattgcagagtcgctaggtggaagtggatatagtgttgagagattgtcagttccgtatgtaccacaagtaacagatgaagatcgactttctagaagaaaaagcattgtggacaccgtatccattcaggtggatattttatccaacaatgttccttctgatgatgtggttagtaacactgaagaaatcacttttgaagcattgaagaaagcaattgataccagtggaatggaagaacaggaaaaggaaaagaggcgtcttgtgatagagaaatttcagaaagcaccttttgaagaaatagcagcacagtgtgaatccaaagcaaatttgcttcatgatagacttgcccaaatattggaactcaccatacgtcctcctcccagtccatcaggaacactgaccattacttctgggcatgcccaataccaatctgtcccagtctatgagatgaagtttccagatctgtgtgtgtactgatcggcgcatgaagacctcaggatatgatttgtaaagcctaaaaattaaggccaagctgagctttcagggtttacttaatgtgtattaacatacttcttgaaaataatgatggaacatatctttaaccaaatgtttggcataccatattagaagttttggagctatatataatttcgagtactttcaaagatagatttatgccatgttaatttgctttgaggttcctgttgcctttttaagttgaacatgttttggtttcactttattccactgttaagtagtatgttttaaacttttcacaaatgtaatgttttttaaaaagtaagccttcagaggattgaaactgtataaattgtttatctcttaaacatctacacagccgcttagatgtagaatttttgttgttgttttctgcaaaggcagatacatttaaatatattcctagtcctgggactgcaaaactgttcggtggctttttgtccccatgctttagataagctgggataggcaccttgctattcagttactataataatatgtgataggcattcctcatcttcttcacaataataggacatctgttgaatagcattcctcgaatataaccctaaaaacgccatactttaaattgtctggttcttgtaatattgtgtttcctgccaagagtttgaccattctgcttgagaagtgtagagcttactcttggagtaccaaactgtgcaatatttttacatcataagatgtattagtttacaggctgtgctttgaaattatagtagtattttgctgtggctccattaattaaatgagatatatatttagtgcagaaaaaagacatttaaaacagctattagttcacctgtgaagagtctgtacattttgatttctattaagagcacatttatttacatttgtatattattttaaatcctcatagtcaaaaaattctccagatggacttttaatttgtaagatttgaactgtgacttgtatacatctgtttagaatcaattatatttgaaaagctgcctgtgttttaacagtcaagtgtgctaaagtttgtcaatttaagctgcttttgatttcagctaccaagatcacaggtgcactctacacataacactgacagacccataacattacatacatcttagtgaattctatcacatggtaaaatgaacagctttctttgtaactcataaaattctcttaggacatttttataaagtcacctgtttatagttctatcttttcagattccatttctttttacataaaacagcatacatatcaaaaactgtagcctagaatacagtttaatttttggcttttgtttttgtttaaaaaattgcagtgaagaatgggatgtttgtgtttatggctatttgggcacctttagtagaaacagacaaaagtaaggaaacgataataggacaagcatacttgaaaatttctgaatacttaaacaaaagcgcaacatcttgaaaaccagtctagtcattgaaacctatgaaatgacactgaaagatcctgggctgcttcttaaataagtagatcagcaagacttgtttcagagtgacagtggagtcgttaccgctggaggactaaagggccctgtggcagctgtcactggaactttgcctcttgatcaggaaaaatgcttcaccagtccgtaaagccaagttgtatttttttaattgcccttttttccttctgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgttaatcattctctttttgctgt

SEQ ID NO: 9304 - DNA, 4972 bp, Homo sapiens
gaggagtgggctggcggcggtagctgtcgcccgcttggttgcgtgaccgcggggtccgcgtccgctccctccacccttcgcccttcgcccttcgcctcgttccggcctccgcggcccagcaacggccgtcatggtgccgtcggcgctccctgcgcggccccgctgagcctcggtgcggcggcgagcgcggtcgagatcgccatgcctacccgagtatgctgctgctgttccgctttgcgtcctcgctacaaacgcctggtggacaacatattccctgaagatccaaaagatggccttgtgaaaactgatatggagaaattgacattttatgcagtatctgctccagagaaactggatcgaattggttcttacctggcagaaaggttgagcagggatgttgtcagacatcgttctgggtatgttttgattgctatggaggcactggaccaacttctcatggcttgccattctcaaagcattaagccatttgtagaaagctttcttcatatggtggcaaagctgctggaatcgggggaaccaaagcttcaagttcttggaacaaattcttttgtcaaatttgcaaatattgaagaagacacaccatcctatcacagacgttatgacttttttgtgtctcgattcagtgccatgtgccattcctgtcatagtgatccagaaatacgaacagagatacgaattgctggaattagaggtattcaaggtgtggttcgcaaaacagtcaacgatgaacttcgggccaccatttgggaacctcagcatatggataagattgttccatccctcctgtttaacatgcaaaagatagaagaagttgacagtcgcataggccctccttcttctccttctgcaactgacaaagaagagaatcctgctgtgctggctgaaaactgtttcagagaactgctgggtcgagcaacttttgggaatatgaataatgctgttagaccagtttttgcgcatttagatcatcacaaactgtgggatcccaatgaatttgcagttcactgctttaaaattataatgtattccattcaggctcagtattctcaccatgtgatccaggagattctaggacaccttgatgctcgtaaaaaagatgctccccgggttcgagcaggtattattcaggttctgttagaggctgttgccattgctgctaaaggttccataggtccgacagtgctggaagtcttcaatacccttttgaaacatctgcgtctcagcgttgaattcgaagcaaatgatttacaggggggatctgtaggcagtgtcaacttaaatacaagttccaaagacaatgatgagaagattgtgcagaatgctatcatccaaacaataggattttttggaagtaacctaccagattatcagaggtcagaaatcatgatgttcattatggggaaagtacctgtctttggaacatctacccatactttggatatcagtcaactaggggatttgggaaccaggagaattcagataatgttgctgagatctttgcttatggtgacctctggatataaagcgaagacgattgttactgcactgccagggtctttcctggatcctttgttatcaccatctctcatggaggactacgaactgagacagttggtcttggaagtaatgcataatctcatggatcgtcatgacaatagggcaaagcttcgagggatcagaataataccggatgtagctgacctaaagataaaaagagaaaaaatttgcagacaagacacaagtttcatgaaaaagaatgggcaacagctgtatcggcacatatatttgggttgtaaagaggaagacaacgttcagaaaaactatgaactactttatacttctcttgctcttataactattgaactggctaatgaagaagtagttattgatctcattcgactggccattgctttacaggacagtgcaattatcaatgaggataatttgccaatgttccatcgttgtggaatcatggcactggttgcagcatacctcaactttgtaagtcagatgatagctgtccctgcattttgccagcatgttagcaaggttattgaaattcgaagaagccccttattttctaccagagcatatcttcagagataagtgcatgcttccaaaatctttagagaagcatgaaaaagatttgtactttctgaccaacaagattgcagagtcgctaggtggaagtggatatagtgttgagagattgtcagttccgtatgtaccacaagtaacagatgaagatcgactttctagaagaaaaagcattgtggacaccgtatccattcaggtggatattttatccaacaatgttccttctgatgatgtggttagtaacactgaagaaatcacttttgaagcattgaagaaagcaattgataccagtggaatggaagaacaggaaaaggaaaagaggcgtcttgtgatagagaaatttcagaaagcaccttttgaagaaatagcagcacagtgtgaatccaaagcaaatttgcttcatgatagacttgcccaaatattggaactcaccatacgtcctcctcccagtccatcaggaacactgaccattacttctgggcatgcccaataccaatctgtcccagtctatgagatgaagtttccagatctgtgtgtgtactgatcggcgcatgaagacctcaggatatgatttgtaaagcctaaaaattaaggccaagctgagctttcagggtttacttaatgtgtattaacatacttcttgaaaataatgatggaacatatctttaaccaaatgtttggcataccatattagaagttttggagctatatataatttcgagtactttcaaagatagatttatgccatgttaatttgctttgaggttcctgttgcctttttaagttgaacatgttttggtttcactttattccactgttaagtagtatgttttaaacttttcacaaatgtaatgttttttaaaaagtaagccttcagaggattgaaactgtataaattgtttatctcttaaacatctacacagccgcttagatgtagaatttttgttgttgttttctgcaaaggcagatacatttaaatatattcctagtcctgggactgcaaaactgttcggtggctttttgtccccatgctttagataagctgggataggcaccttgctattcagttactataataatatgtgataggcattcctcatcttcttcacaataataggacatctgttgaatagcattcctcgaatataaccctaaaaacgccatactttaaattgtctggttcttgtaatattgtgtttcctgccaagagtttgaccattctgcttgagaagtgtagagcttactcttggagtaccaaactgtgcaatatttttacatcataagatgtattagtttacaggctgtgctttgaaattatagtagtattttgctgtggctccattaattaaatgagatatatatttagtgcagaaaaaagacatttaaaacagctattagttcacctgtgaagagtctgtacattttgatttctattaagagcacatttatttacatttgtatattattttaaatcctcatagtcaaaaaattctccagatggacttttaatttgtaagatttgaactgtgacttgtatacatctgtttagaatcaattatatttgaaaagctgcctgtgttttaacagtcaagtgtgctaaagtttgtcaatttaagctgcttttgatttcagctaccaagatcacaggtgcactctacacataacactgacagacccataacattacatacatcttagtgaattctatcacatggtaaaatgaacagctttctttgtaactcataaaattctcttaggacatttttataaagtcacctgtttatagttctatcttttcagattccatttctttttacataaaacagcatacatatcaaaaactgtagcctagaatacagtttaatttttggcttttgtttttgtttaaaaaattgcagtgaagaatgggatgtttgtgtttatggctatttgggcacctttagtagaaacagacaaaagtaaggaaacgataataggacaagcatacttgaaaatttctgaatacttaaacaaaagcgcaacatcttgaaaaccagtctagtcattgaaacctatgaaatgacactgaaagatcctgggctgcttcttaaataagtagatcagcaagacttgtttcagagtgacagtggagtcgttaccgctggaggactaaagggccctgtggcagctgtcactggaactttgcctcttgatcaggaaaaatgcttcaccagtccgtaaagccaagttgtatttttttaattgcccttttttccttctgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgttaatcattctctttttgctgt

SEQ ID NO: 9305 - DNA, 5247 bp, Homo sapiens
acagatgaggaccagtaaacacaatagaaagtttatttaatgtggagtatgctgctgctgttccgctttgcgtcctcgctacaaacgcctggtggacaacatattccctgaagatccaaaagatggccttgtgaaaactgatatggagaaattgacattttatgcagtatctgctccagagaaactggatcgaattggttcttacctggcagaaaggttgagcagggatgttgtcagacatcgttctgggtatgttttgattgctatggaggcactggaccaacttctcatggcttgccattctcaaagcattaagccatttgtagaaagctttcttcatatggtggcaaagctgctggaatcgggggaaccaaagcttcaagttcttggaacaaattcttttgtcaaatttgcaaatattgaagaagacacaccatcctatcacagacgttatgacttttttgtgtctcgattcagtgccatgtgccattcctgtcatagtgatccagaaatacgaacagagatacgaattgctggaattagaggtattcaaggtgtggttcgcaaaacagtcaacgatgaacttcgggccaccatttgggaacctcagcatatggataagattgttccatccctcctgtttaacatgcaaaagatagaagaagttgacagtcgcataggccctccttcttctccttctgcaactgacaaagaagagaatcctgctgtgctggctgaaaactgtttcagagaactgctgggtcgagcaacttttgggaatatgaataatgctgttagaccagtttttgcgcatttagatcatcacaaactgtgggatcccaatgaatttgcagttcactgctttaaaattataatgtattccattcaggctcagtattctcaccatgtgatccaggagattctaggacaccttgatgctcgtaaaaaagatgctccccgggttcgagcaggtattattcaggttctgttagaggctgttgccattgctgctaaaggttccataggtccgacagtgctggaagtcttcaatacccttttgaaacatctgcgtctcagcgttgaattcgaagcaaatgatttacaggggggatctgtaggcagtgtcaacttaaatacaagttccaaagacaatgatgagaagattgtgcagaatgctatcatccaaacaataggattttttggaagtaacctaccagattatcagaggtcagaaatcatgatgttcattatggggaaagtacctgtctttggaacatctacccatactttggatatcagtcaactaggggatttgggaaccaggagaattcagataatgttgctgagatctttgcttatggtgacctctggatataaagcgaagacgattgttactgcactgccagggtctttcctggatcctttgttatcaccatctctcatggaggactacgaactgagacagttggtcttggaagtaatgcataatctcatggatcgtcatgacaatagggcaaagcttcgagggatcagaataataccggatgtagctgacctaaagataaaaagagaaaaaatttgcagacaagacacaagtttcatgaaaaagaatgggcaacagctgtatcggcacatatatttgggttgtaaagaggaagacaacgttcagaaaaactatgaactactttatacttctcttgctcttataactattgaactggctaatgaagaagtagttattgatctcattcgactggccattgctttacaggacagtgcaattatcaatgaggataatttgccaatgttccatcgttgtggaatcatggcactggttgcagcatacctcaactttgtaagtcagatgatagctgtccctgcattttgccagcatgttagcaaggttattgaaattcgaactatggaagccccttattttctaccagagcatatcttcagagataagtgcatgcttccaaaatctttagagaagcatgaaaaagatttgtactttctgaccaacaagattgcagagtcgctaggtggaagtggatatagtgttgagagattgtcagttccgtatgtaccacaagtaacagatgaagatcgactttctagaagaaaaagcattgtggacaccgtatccattcaggtggatattttatccaacaatgttccttctgatgatgtggttagtaacactgaagaaatcacttttgaagcattgaagaaagcaattgataccagtggaatggaagaacaggaaaaggaaaagaggcgtcttgtgatagagaaatttcagaaagcaccttttgaagaaatagcagcacagtgtgaatccaaagcaaatttgcttcatgatagacttgcccaaatattggaactcaccatacgtcctcctcccagtccatcaggaacactgaccattacttctgggcatgcccaataccaatctgtcccagtctatgagatgaagtttccagatctgtgtgtgtactgatcggcgcatgaagacctcaggatatgatttgtaaagcctaaaaattaaggccaagctgagctttcagggtttacttaatgtgtattaacatacttcttgaaaataatgatggaacatatctttaaccaaatgtttggcataccatattagaagttttggagctatatataatttcgagtactttcaaagatagatttatgccatgttaatttgctttgaggttcctgttgcctttttaagttgaacatgttttggtttcactttattccactgttaagtagtatgttttaaacttttcacaaatgtaatgttttttaaaaagtaagccttcagaggattgaaactgtataaattgtttatctcttaaacatctacacagccgcttagatgtagaatttttgttgttgttttctgcaaaggcagatacatttaaatatattcctagtcctgggactgcaaaactgttcggtggctttttgtccccatgctttagataagctgggataggcaccttgctattcagttactataataatatgtgataggcattcctcatcttcttcacaataataggacatctgttgaatagcattcctcgaatataaccctaaaaacgccatactttaaattgtctggttcttgtaatattgtgtttcctgccaagagtttgaccattctgcttgagaagtgtagagcttactcttggagtaccaaactgtgcaatatttttacatcataagatgtattagtttacaggctgtgctttgaaattatagtagtattttgctgtggctccattaattaaatgagatatatatttagtgcagaaaaaagacatttaaaacagctattagttcacctgtgaagagtctgtacattttgatttctattaagagcacatttatttacatttgtatattattttaaatcctcatagtcaaaaaattctccagatggacttttaatttgtaagatttgaactgtgacttgtatacatctgtttagaatcaattatatttgaaaagctgcctgtgttttaacagtcaagtgtgctaaagtttgtcaatttaagctgcttttgatttcagctaccaagatcacaggtgcactctacacataacactgacagacccataacattacatacatcttagtgaattctatcacatggtaaaatgaacagctttctttgtaactcataaaattctcttaggacatttttataaagtcacctgtttatagttctatcttttcagattccatttctttttacataaaacagcatacatatcaaaaactgtagcctagaatacagtttaatttttggcttttgtttttgtttaaaaaattgcagtgaagaatgggatgtttgtgtttatggctatttgggcacctttagtagaaacagacaaaagtaaggaaacgataataggacaagcatacttgaaaatttctgaatacttaaacaaaagcgcaacatcttgaaaaccagtctagtcattgaaacctatgaaatgacactgaaagatcctgggctgcttcttaaataagtagatcagcaagacttgtttcagagtgacagtggagtcgttaccgctggaggactaaagggccctgtggcagctgtcactggaactttgcctcttgatcaggaaaaatgcttcaccagtccgtaaagccaagttgtatttttttaattgcccttttttccttctgtatttttaaagaaggatgttaatttttgactatatattttaaaaaaatctaagcagggggacatgcaaaaacaatcatcatccacttggatgtcattttatagattaacactgtgtgcttttgtatggaaaaaatatatataatttaatagtataaaaaataaaatatatattcatttgcacttacgtgaaacacaaactttgctctacaaaatttcgtgtttcttagtgattttaaaatgcatgtattgcatgtaaaggaaaaccattacaattaatgtttatcacacctttatcttggtctttgttgatttgggttttgttggggtttttgttactgtttttaaattacagtaggcttctatatatcctggatttctgaactggtcttgttgacaaggattcccaagaaatggatcttttcactggctgactctcccatatctgcaagagattctgcaggaactgggtgtgcacacggtgttgtagccagttcaggtactgaatatttaggatttggtgaagttcactgtattgctatatttttgtagataaataaaactcaataaattgttaatcattctctttttgctgtatagaattgcttatatcactctttctttcatgacattggttaacatttaaatgttcctcctgtacttgtgttgtctgtgaccgcttatagagttttattgttattggtgtttacctgaatacctatgcgtacacacacacatatttccttaatacttctgaactcattatcttttagaataataatactactacactttaccagcaattaacttctccctacccaaaatgtttttcttcctgtctgaaaatggaactaatttgtcttattcgtgcttatatctgtattaaatgcaataaagttagtttttgaaatgtaaaaattcactgtgcaattcatatgtcagcaataaaacatagattatttgtatataagttcatttttatagctattgttacatttaattaaatttattcaatatttgcttaaattaaaaa

SEQ ID NO: 9306 - DNA, 1820 bp, Homo sapiens
agatcagacccacggggctgccctcccctgcgcactcccctcgctgcccgggcccggagcgcagcgcggccgcacaggtatttttgctgtgctgtgcaaggaactctgctagctcaagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaa

SEQ ID NO: 9307 - DNA, 2917 bp, Homo sapiens
cgaaggtagcgtgtcggggacccagactgataagacaaaagagaatcagtcgctttgggctgcccctccacacaacctgggacttttaaacaaagctgtgcgcagagaaaggcgtggaaatgccactttgagagtttgtgctgggggatgtgagaagctctgagacatgtgagaaggtctagtattctactagaactggaagattgctctccgagttttgttttgttattttgtttaaaaaataaaaagcttgaggccaaggcaattcatattggctcacaggtatttttgctgtgctgtgcaaggaactctgctagctcaagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggggatctgccatatttgtgttggtttttattttcatatccagcctaaaggtggttgtttattatatagtaataaatcattgctgtacaatatgctggtttctgtagggtatttttaattttgtcagaaattttagattgtgaatattttgtaaaaaacagtaagcaaaattttccagaattcccaaaatgaaccagatatcccctagaaaattatactattgagaaatctatggggaggatatgagaaaataaattccttctaaaccacattggaactgacctgaagaagcaaactcggaaaatataataacatccctgaattcaggacttccacaagatgcagaacaaaatggataaaaggtatttcactggagaagttttaatttctaagtaaaatttaaatcctaacacttcactaatttataactaaaatttctcatcttcgtacttgatgctcacagaggaagaaaatgatgatggtttttattcctggcatccagagtgacagtgaacttaagcaaattaccctcctacccaattctatggaatattttatacgtctccttgtttaaaatgtcactgctttactttgatgtatcatatttttaaataaaaataaatattcctttagaagatc

SEQ ID NO: 9308 - DNA, 3024 bp, Homo sapiens
agatgctgtgttcccctcctcagagaagaagaaaacgcactagagagtgggagcatccccaaggctgaagcgcatccaggacatcacatgtcaacgtgtcctctctggcgtggggtccccgcgagtctgggaaacgaggagctggcaagggagggcaagcgggggcggcaaagagggcccctggagcagggggcgcggacctcgctgcgctgcgcgctctaccgccgggctcgcaacgctgggctcagcgctcgcgcctccctcagctctctcctccgccccccttcgccctccccctttccctccctttctcctcctcctcctgccgccgcggccgctgccggacttcgccagatcagacccacggggctgccctcccctgcgcactcccctcgctgcccgggcccggagcgcagcgcggccgcacagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggggatctgccatatttgtgttggtttttattttcatatccagcctaaaggtggttgtttattatatagtaataaatcattgctgtacaatatgctggtttctgtagggtatttttaattttgtcagaaattttagattgtgaatattttgtaaaaaacagtaagcaaaattttccagaattcccaaaatgaaccagatatcccctagaaaattatactattgagaaatctatggggaggatatgagaaaataaattccttctaaaccacattggaactgacctgaagaagcaaactcggaaaatataataacatccctgaattcaggacttccacaagatgcagaacaaaatggataaaaggtatttcactggagaagttttaatttctaagtaaaatttaaatcctaacacttcactaatttataactaaaatttctcatcttcgtacttgatgctcacagaggaagaaaatgatgatggtttttattcctggcatccagagtgacagtgaacttaagcaaattaccctcctacccaattctatggaatattttatacgtctccttgtttaaaatgtcactgctttactttgatgtatcatatttttaaataaaaataaatattcctttagaagatca

SEQ ID NO: 9309 - DNA, 1837 bp, Homo sapiens
agatcagacccacggggctgccctcccctgcgcactcccctcgctgcccgggcccggagcgcagcgcggccgcacaggtatttttgctgtgctgtgcaaggaactctgctagctcaagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacatagatgaatgtaccatccctccatattgccaccaaagatgcgtgaatacaccaggctcattttattgccagtgcagtcctgggtttcaattggcagcaaacaactatacctgcgtagatataaatgaatgtgatgccagcaatcaatgtgctcagcagtgctacaacattcttggttcattcatctgtcagtgcaatcaaggatatgagctaagcagtgacaggctcaactgtgaagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggg

SEQ ID NO: 9310 - DNA, 547 bp, Homo sapiens
acttcgccagatcagacccacggggctgccctcccctgcgcactcccctcgctgcccgggcccggagcgcagcgcggccgcacagcctgctttgtaggtgcagtataaaatgcacgctgaatgtcttttgtatgtaaacagcgtagcaggatggagtaacgtgaaatgcaattctacagcagtttttacgtctttgctgcctcgttcgttggctaccgagaaggttcaggagggggaggggagatgagaaagcagattggaagttgagtatggtggagcctcagcctctcccaccctcctttcctcgcttgtgctcactgctaaagttttgttactttccccgcagcagatactaaacattagtttgtcctgtattttctttgagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtccc

SEQ ID NO: 9311 - DNA, 339 bp, Homo sapiens
agacccacggggctgccctcccctgcgcactcccctcgctgcccgggcccggagcgcagcgcggccgcacaggtatttttgctgtgctgtgcaaggaactctgctagctcaagcctgctttgtaggtgcagtataaaatgcacgctgaatgtcttttgtatgtaaacagcgtagcaggatggagtaacgtgaaatgcaattctacagcagtttttacgtctttgctgcctcgttcgttggctaccgagaagattcacaatgttgaaagcccttttcctaactatgctgactctggcgctggtcaagtcacaggacaccgaagaaaccatcacgtacacg

SEQ ID NO: 9312 - DNA, 1809 bp, Homo sapiens
acggggctgccctcccctgcgcactcccctcgctgcccgggcccggagcgcagcgcggccgcacagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagaagattcctgacttattttattactgaccacagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaagacatagacgagtgcactgcagggacgcacaactgtagagcagaccaagtgtgcatcaatttacggggatcctttgcatgtcagtgccctcctggatatcagaagcgaggggagcagtgcgtagacattgatgaatgcagaacctcaagctacctgtgtcaatatcaatgtgtcaatgaacctgggaaattctcatgtatgtgcccccagggataccaagtggtgagaagtagaacatgtcaagatataaatgagtgtgagaccacaaatgaatgccgggaggatgaaatgtgttggaattatcatggcggcttccgttgttatccacgaaatccttgtcaagatccctacattctaacaccagagaaccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgacaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttag

SEQ ID NO: 9313 - DNA, 558 bp, Homo sapiens
agacccacggggctgccctcccctgcgcactcccctcgctgcccgggcccggagcgcagcgcggccgcacaggtatttttgctgtgctgtgcaaggaactctgctagctcaagcctgctttgtaggtgcagtataaaatgcacgctgaatgtcttttgtatgtaaacagcgtagcaggatggagtaacgtgaaatgcaattctacagcagtttttacgtctttgctgcctcgttcgttggctaccgagaaggttcaggagggggaggggagatgagaaagcagattggaaattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaa

SEQ ID NO: 9314 - DNA, 733 bp, Homo sapiens
gacccacggggctgccctcccctgcgcactcccctcgctgcccgggcccggagcgcagcgcggccgcacagcctgctttgtaggtgcagtataaaatgcacgctgaatgtcttttgtatgtaaacagcgtagcaggatggagtaacgtgaaatgcaattctacagcagtttttacgtctttgctgcctcgttcgttggctaccgagaagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaag

SEQ ID NO: 9315 - DNA, 572 bp, Homo sapiens
acttcgccagatcagacccacggggctgccctcccctgcgcactcccctcgctgcccgggcccggagcgcagcgcggccgcacaggtatttttgctgtgctgtgcaaggaactctgctagctcaagcgtagcaggatggagtaacgtgaaatgcaattctacagcagtttttacgtctttgctgcctcgttcgttggctaccgagaagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtg

SEQ ID NO: 9316 - DNA, 559 bp, Homo sapiens
agacccacggggctgccctcccctgcgcactcccctcgctgcccgggcccggagcgcagcgcggccgcacaggtatttttgctgtgctgtgcaaggaactctgctagctcaagcgtagcaggatggagtaacgtgaaatgcaattctacagcagtttttacgtctttgctgcctcgttcgttggctaccgagaaggttcaggagggggaggggagatgagaaagcagattggaaattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagc

SEQ ID NO: 9317 - DNA, 552 bp, Homo sapiens
atcagacccacggggctgccctcccctgcgcactcccctcgctgcccgggcccggagcgcagcgcggccgcacaggtatttttgctgtgctgtgcaaggaactctgctagctcaagcgtagcaggatggagtaacgtgaaatgcaattctacagcagtttttacgtctttgctgcctcgttcgttggctaccgagaaggttcaggagggggaggggagatgagaaagcagattggaagttgagtatggtggagcctcagcctctcccaccctcctttcctcgcttgtgctcactgctaaagttttgttactttccccgcagcagatactaaacattagtttgtcctgtattttctttgagattcacaatgttgaaagcccttttcctaactatgctgactctggcgctggtcaagtcacaggacaccgaagaaaccatcacgtacacgcaatgcactgacggatatgagtgggatcctgtgagacagcaatgcaaagatattgatgaatgtgacattgtcccagacgcttgtaaaggtggaatgaagtgtgt

SEQ ID NO: 9318 - DNA, 2034 bp, Homo sapiens
gcggggggtcggggtccctccccctggcgctggctcaggaatccgccgaagggcgggcggaggcgccggggtgggccgcgccgcggcaggcgggcgggcggggggcgcttcctggggccgcgcgtccagggagctgtgccgtccgcccgtccgtctgcccgcaggcattgcccgagccagccgagccgccagagccgcgggccgcgggggtgtcgcgggcccaaccccaggatgctcccctgcgcctcctgcctacccgggtctctactgctctgggcgctgctactgttgctcttgggatcagcttctcctcaggattctgaagagcccgacagctacacggaatgcacagatggctatgagtgggacccagacagccagcactgccgggatgtcaacgagtgtctgaccatccctgaggcctgcaagggggaaatgaagtgcatcaaccactacgggggctacttgtgcctgccccgctccgctgccgtcatcaacgacctacacggcgagggacccccgccaccagtgcctcccgctcaacaccccaacccctgcccaccaggctatgagcccgacgatcaggacagctgtgtggatgtggacgagtgtgcccaggccctgcacgactgtcgccccagccaggactgccataacttgcctggctcctatcagtgcacctgccctgatggttaccgcaagatcgggcccgagtgtgtggacatagacgagtgccgctaccgctactgccagcaccgctgcgtgaacctgcctggctccttccgctgccagtgcgagccgggcttccagctggggcctaacaaccgctcctgtgttgatgtgaacgagtgtgacatgggggccccatgcgagcagcgctgcttcaactcctatgggaccttcctgtgtcgctgccaccagggctatgagctgcatcgggatggcttctcctgcagtgatattgatgagtgtagctactccagctacctctgtcagtaccgctgcatcaacgagccaggccgtttctcctgccactgcccacagggttaccagctgctggccacacgcctctgccaagacattgatgagtgtgagtctggtgcgcaccagtgctccgaggcccaaacctgtgtcaacttccatgggggctaccgctgcgtggacaccaaccgctgcgtggagccctacatccaggtctctgagaaccgctgtctctgcccggcctccaaccctctatgtcgagagcagccttcatccattgtgcaccgctacatgaccatcacctcggagcggagcgtgcccgctgacgtgttccagatccaggcgacctccgtctaccccggtgcctacaatgcctttcagatccgtgctggaaactcgcagggggacttttacattaggcaaatcaacaacgtcagcgccatgctggtcctcgcccggccggtgacgggcccccgggagtacgtgctggacctggagatggtcaccatgaattccctcatgagctaccgggccagctctgtactgaggctcaccgtctttgtaggggcctacaccttctgaggagcaggagggagccaccctccctgcagctaccctagctgaggagcctgttgtgaggggcagaatgagaaaggcaataaagggagaaagaaagtcctggtggctgaggtgggcgggtcacactgcaggaagcctcaggctggggcagggtggcacttgggggggcaggccaagttcacctaaatgggggtctctatatgttcaggcccaggggcccccattgacaggagctgggagctctgcaccacgagcttcagtcaccccgagaggagaggaggtaacgaggagggcggactccaggccccggcccagagatttggacttggctggcttgcaggggtcctaagaaactccactctggacagcgccaggaggccctgggttccattcctaactctgcctcaaactgtacatttggataagccctagtagttccctgggcctgtttttctataaaacgaggcaactgga

SEQ ID NO: 9319 - DNA, 907 bp, Homo sapiens
gggcgtgggccggagtctcggccgagtccgcggcagcgtagcgcccacagaggcccgcgctcctcggccttcgccgcaggggcgcggggcgggggcggggtggccggggcgggtgggcctgggacccgggcctgggacctgggcctgtgaggagtcggcccccagccctgggaggccccgaggcccaagcacggtcctgagcgggcagtggcgggggctgggctcgggctcccggtacagggagttgaggtgccgcgggcagaggcccctgacccgtgtccaccatctcgcagccccaggatgctcccctgcgcctcctgcctacccgggtctctactgctctgggcgctgctactgttgctcttgggatcagcttctcctcaggattctgaagagcccgacagctacacggaatgcacagatggctatgagtgggacccagacagccagcactgccgggatgtcaacgagtgtctgaccatccctgaggcctgcaagggggaaatgaagtgcatcaaccactacgggggctacttgtgcctgccccgctccgctgccgtcatcaacgacctacacggcgagggacccccgccaccagtgcctcccgctcaacaccccaacccctgcccaccaggctatgagcccgacgatcaggacagctgtgtggatgtggacgagtgtgcccaggccctgcacgactgtcgccccagccaggactgccataacttgcctggctcctatcagtgcacctgccctgatggttaccgcaagatcgggcccgagtgtgtggacatagacgagtgccgctaccgctactgccagcaccgctgcgtgaacctgcctggctccttccgctgccagtgcgagccgggcttccagctggggcctaacaaccgctcctgtgttg

SEQ ID NO: 9320 - DNA, 614 bp, Homo sapiens
gacgctggtgcgaggaggtcgaggaggcgccttggcacccgactctggcatcccgcacccccaggatgctcccctgcgcctcctgcctacccgggtctctactgctctgggcgctgctactgttgctcttgggatcagcttctcctcaggattctgaagagcccgacagctacacggaatgcacagatggctatgagtgggacccagacagccagcactgccgggatgtcaacgagtgtctgaccatccctgaggcctgcaagggggaaatgaagtgcatcaaccactacgggggctacttgtgcctgccccgctccgctgccgtcatcaacgacctacacggcgagggacccccgccaccagtgcctcccgctcaacaccccaacccctgcccaccaggctatgagcccgacgatcaggacagctgtgtggatgtggacgagtgtgcccaggccctgcacgactgtcgccccagccaggactgccataacttgcctggctcctatcagtgcacctgccctgatggttaccgcaagatcgggcccgagtgtgtggacatagacgagtgccgctaccgctactgccagcaccgctgcgtgaacctgcctggctcc

SEQ ID NO: 9321 - DNA, 1813 bp, Homo sapiens
gggcggggggcgcttcctggggccgcgcgtccagggagctgtgccgtccgcccgtccgtctgcccgcaggcattgcccgagccagccgagccgccagagccgcgggccgcgggggtgtcgcgggcccaaccccaggatgctcccctgcgcctcctgcctacccgggtctctactgctctgggcgctgctactgttgctcttgggatcagcttctcctcaggattctgaagagcccgacagctacacggaatgcacagatggctatgagtgggacccagacagccagcactgccgggatgtcaacgagtgtctgaccatccctgaggcctgcaagggggaaatgaagtgcatcaaccactacgggggctacttgtgcctgccccgctccgctgccgtcatcaacgacctacacggcgagggacccccgccaccagtgcctcccgctcaacaccccaacccctgcccaccaggctatgagcccgacgatcaggacagctgtgtggatgtggacgagtgtgcccaggccctgcacgactgtcgccccagccaggactgccataacttgcctggctcctatcagtgcacctgccctgatggttaccgcaagatcgggcccgagtgtgtggacatagacgagtgccgctaccgctactgccagcaccgctgcgtgaacctgcctggctccttccgctgccagtgcgagccgggcttccagctggggcctaacaaccgctcctgtgttgatgtgaacgagtgtgacatgggggccccatgcgagcagcgctgcttcaactcctatgggaccttcctgtgtcgctgccaccagggctatgagctgcatcgggatggcttctcctgcagtgatattgatgagtgtagctactccagctacctctgtcagtaccgctgcatcaacgagccaggccgtttctcctgccactgcccacagggttaccagctgctggccacacgcctctgccaagacattgatgagtgtgagtctggtgcgcaccagtgctccgaggcccaaacctgtgtcaacttccatgggggctaccgctgcgtggacaccaaccgctgcgtggagccctacatccaggtctctgagaaccgctgtctctgcccggcctccaaccctctatgtcgagagcagccttcatccattgtgcaccgctacatgaccatcacctcggagcggagcgtgcccgctgacgtgttccagatccaggcgacctccgtctaccccggtgcctacaatgcctttcagatccgtgctggaaactcgcagggggacttttacattaggcaaatcaacaacgtcagcgccatgctggtcctcgcccggccggtgacgggcccccgggagtacgtgctggacctggagatggtcaccatgaattccctcatgagctaccgggccagctctgtactgaggctcaccgtctttgtaggggcctacaccttctgaggagcaggagggagccaccctccctgcagctaccctagctgaggagcctgttgtgaggggcagaatgagaaaggcccaggggcccccattgacaggagctgggagctctgcaccacgagcttcagtcaccccgagaggagaggaggtaacgaggagggcggactccaggccccggcccagagatttggacttggctggcttgcaggggtcctaagaaactccactctggacagcgccaggaggccctgggttccattcctaactctgcctcaaactgtacatttggataagccctagtagttccctgggcctgtttttctataaaacgaggcaactggactgtta

SEQ ID NO: 9322 - DNA, 2657 bp, Homo sapiens
cttttctttgaatgacagaactacagcataatgcgtggcttcaacctgctcctcttctggggatgttgtgttatgcacagctgggaagggcacataagacccacacggaaaccaaacacaaagggtaataactgtagagacagtaccttgtgcccagcttatgccacctgcaccaatacagtggacagttactattgcgcttgcaaacaaggcttcctgtccagcaatgggcaaaatcacttcaaggatccaggagtgcgatgcaaagatattgatgaatgttctcaaagcccccagccctgtggtcctaactcatcctgcaaaaacctgtcagggaggtacaagtgcagctgtttagatggtttctcttctcccactggaaatgactgggtcccaggaaagccgggcaatttctcctgtactgatatcaatgagtgcctcaccagcagcgtctgccctgagcattctgactgtgtcaactccatgggaagctacagttgcagctgtcaagttggattcatctctagaaactccacctgtgaagacgtggatgaatgtgcagatccaagagcttgcccagagcatgcaacttgtaataacactgttggaaactactcttgtttctgcaacccaggatttgaatccagcagtggccacttgagtttccagggtctcaaagcatcgtgtgaagatattgatgaatgcactgaaatgtgccccatcaattcaacatgcaccaacactcctgggagctacttttgcacctgccaccctggctttgcaccaagcaatggacagttgaatttcacagaccaaggagtggaatgtagagatattgatgagtgccgccaagatccatcaacctgtggtcctaattctatctgcaccaatgccctgggctcctacagctgtggctgcattgcaggctttcatcccaatccagaaggctcccagaaagatggcaacttcagctgccaaagggttctcttcaaatgtaaggaagatgtgatacccgataataagcagatccagcaatgccaagagggaaccgcagtgaaacctgcatatgtctccttttgtgcacaaataaataacatcttcagcgttctggacaaagtgtgtgaaaataaaacgaccgtagtttctctgaagaatacaactgagagctttgtccctgtgcttaaacaaatatccacgtggactaaattcaccaaggaagagacgtcctccctggccacagtcttcctggagagtgtggaaagcatgacactggcatctttttggaaaccctcagcaaatatcactccggctgttcggacggaatacttagacattgagagcaaagttatcaacaaagaatgcagtgaagagaatgtgacgttggacttggtagccaagggggataagatgaagatcgggtgttccacaattgaggaatctgaatccacagagaccactggtgtggcttttgtctcctttgtgggcatggaatcggttttaaatgagcgcttcttcaaagaccaccaggctcccttgaccacctctgagatcaagctgaagatgaattctcgagtcgttgggggcataatgactggagagaagaaagacggcttctcagatccaatcatctacactctggagaacattcagccaaagcagaagtttgagaggcccatctgtgtttcctggagcactgatgtgaagggtggaagatggacatcctttggctgtgtgatcctggaagcttctgagacatataccatctgcagctgtaatcagatggcaaatcttgccgttatcatggcgtctggggagctcacgatgggctgcgccatcatcgcgggcttcctgcactaccttttccttgcctgcttcttctggatgctggtggaggctgtgatactgttcttgatggtcagaaacctgaaggtggtgaattacttcagctctcgcaacatcaagatgctgcacatctgtgcctttggttatgggctgccgatgctggtggtggtgatctctgccagtgtgcagccacagggctatggaatgcataatcgctgctggctgaatacagagacagggttcatctggagtttcttggggccagtttgcacagttatagtgatcaactcccttctcctgacctggaccttgtggatcctgaggcagaggctttccagtgttaatgccgaagtctcaacgctaaaagacaccaggttactgaccttcaaggcctttgcccagctcttcatcctgggctgctcctgggtgctgggcatttttcagattggacctgtggcaggtgtcatggcttacctgttcaccatcatcaacagcctgcagggggccttcatcttcctcatccactgtctgctcaacggccaggtacgagaagaatacaagaggtggatcactgggaagacgaagcccagctcccagtcccagacctcaaggatcttgctgtcctccatgccatccgcttccaagacgggttaaagtcctttcttgctttcaaatatgctatggagccacagttgaggacagtagtttcctgcaggagcctaccctgaaatctcttctcagcttaacatggaaatgaggatcccaccagccccagaaccctctggggaagaatgttgggggcggtcttcctgtgg

SEQ ID NO: 9323 - DNA, 3122 bp, Homo sapiens
aaaagtttcttttctttgaatgacagaactacagcataatgcgtggcttcaacctgctcctcttctggggatgttgtgttatgcacagctgggaagggcacataagacccacacggaaaccaaacacaaagggtaataactgtagagacagtaccttgtgcccagcttatgccacctgcaccaatacagtggacagttactattgcgcttgcaaacaaggcttcctgtccagcaatgggcaaaatcacttcaaggatccaggagtgcgatgcaaagatattgatgaatgttctcaaagcccccagccctgtggtcctaactcatcctgcaaaaacctgtcagggaggtacaagtgcagctgtttagatggtttctcttctcccactggaaatgactgggtcccaggaaagccgggcaatttctcctgtactgatatcaatgagtgcctcaccagcagcgtctgccctgagcattctgactgtgtcaactccatgggaagctacagttgcagctgtcaagttggattcatctctagaaactccacctgtgaagacgtggatgaatgtgcagatccaagagcttgcccagagcatgcaacttgtaataacactgttggaaactactcttgtttctgcaacccaggatttgaatccagcagtggccacttgagtttccagggtctcaaagcatcgtgtgaagatattgatgaatgcactgaaatgtgccccatcaattcaacatgcaccaacactcctgggagctacttttgcacctgccaccctggctttgcaccaagcaatggacagttgaatttcacagaccaaggagtggaatgtagagatattgatgagtgccgccaagatccatcaacctgtggtcctaattctatctgcaccaatgccctgggctcctacagctgtggctgcattgcaggctttcatcccaatccagaaggctcccagaaagatggcaacttcagctgccaaagggttctcttcaaatgtaaggaagatgtgatacccgataataagcagatccagcaatgccaagagggaaccgcagtgaaacctgcatatgtctccttttgtgcacaaataaataacatcttcagcgttctggacaaagtgtgtgaaaataaaacgaccgtagtttctctgaagaatacaactgagagctttgtccctgtgcttaaacaaatatccacgtggactaaattcaccaaggaagagacgtcctccctggccacagtcttcctggagagtgtggaaagcatgacactggcatctttttggaaaccctcagcaaatatcactccggctgttcggacggaatacttagacattgagagcaaagttatcaacaaagaatgcagtgaagagaatgtgacgttggacttggtagccaagggggataagatgaagatcgggtgttccacaattgaggaatctgaatccacagagaccactggtgtggcttttgtctcctttgtgggcatggaatcggttttaaatgagcgcttcttcaaagaccaccaggctcccttgaccacctctgagatcaagctgaagatgaattctcgagtcgttgggggcataatgactggagagaagaaagacggcttctcagatccaatcatctacactctggagaacattcagccaaagcagaagtttgagaggcccatctgtgtttcctggagcactgatgtgaagggtggaagatggacatcctttggctgtgtgatcctggaagcttctgagacatataccatctgcagctgtaatcagatggcaaatcttgccgttatcatggcgtctggggagctcacgatggacttttccttgtacatcattagccatgtaggcattatcatctccttggtgtgcctcgtcttggccatcgccacctttctgctgtgtcgctccatccgaaatcacaacacctacctccacctgcacctctgcgtgtgtctcctcttggcgaagactctcttcctcgccggtatacacaagactgacaacaagatgggctgcgccatcatcgcgggcttcctgcactaccttttccttgcctgcttcttctggatgctggtggaggctgtgatactgttcttgatggtcagaaacctgaaggtggtgaattacttcagctctcgcaacatcaagatgctgcacatctgtgcctttggttatgggctgccgatgctggtggtggtgatctctgccagtgtgcagccacagggctatggaatgcataatcgctgctggctgaatacagagacagggttcatctggagtttcttggggccagtttgcacagttatagtgatcaactcccttctcctgacctggaccttgtggatcctgaggcagaggctttccagtgttaatgccgaagtctcaacgctaaaagacaccaggttactgaccttcaaggcctttgcccagctcttcatcctgggctgctcctgggtgctgggcatttttcagattggacctgtggcaggtgtcatggcttacctgttcaccatcatcaacagcctgcagggggccttcatcttcctcatccactgtctgctcaacggccaggtacgagaagaatacaagaggtggatcactgggaagacgaagcccagctcccagtcccagacctcaaggatcttgctgtcctccatgccatccgcttccaagacgggttaaagtcctttcttgctttcaaatatgctatggagccacagttgaggacagtagtttcctgcaggagcctaccctgaaatctcttctcagcttaacatggaaatgaggatcccaccagccccagaaccctctggggaagaatgttgggggcggtcttcctgtggttgtatgcactgatgagaaatcaggcgtttctgctccaaacgaccattttatcttcgtgctctgcaacttcttcaattccagagtttctgagaacagacccaaattcaatggcatgaccaagaacacctggctaccattttgttttctcctgcccttgttggtgcatggttctaagcatgcccctccagagcctatcatacgcctgatacagagaacctctcaataaatgatttgtcgcctgtctgactgatttaccctagg

SEQ ID NO: 9324 - DNA, 3056 bp, Homo sapiens
cttttctttgaatgacagaactacagcataatgcgtggcttcaacctgctcctcttctggggatgttgtgttatgcacagctgggaagggcacataagacccacacggaaaccaaacacaaagggtaataactgtagagacagtaccttgtgcccagcttatgccacctgcaccaatacagtggacagttactattgcgcttgcaaacaaggcttcctgtccagcaatgggcaaaatcacttcaaggatccaggagtgcgatgcaaagatatcaatgagtgcctcaccagcagcgtctgccctgagcattctgactgtgtcaactccatgggaagctacagttgcagctgtcaagttggattcatctctagaaactccacctgtgaagacgtggatgaatgtgcagatccaagagcttgcccagagcatgcaacttgtaataacactgttggaaactactcttgtttctgcaacccaggatttgaatccagcagtggccacttgagtttccagggtctcaaagcatcgtgtgaagatattgatgaatgcactgaaatgtgccccatcaattcaacatgcaccaacactcctgggagctacttttgcacctgccaccctggctttgcaccaagcaatggacagttgaatttcacagaccaaggagtggaatgtagagatattgatgagtgccgccaagatccatcaacctgtggtcctaattctatctgcaccaatgccctgggctcctacagctgtggctgcattgcaggctttcatcccaatccagaaggctcccagaaagatggcaacttcagctgccaaagggttctcttcaaatgtaaggaagatgtgatacccgataataagcagatccagcaatgccaagagggaaccgcagtgaaacctgcatatgtctccttttgtgcacaaataaataacatcttcagcgttctggacaaagtgtgtgaaaataaaacgaccgtagtttctctgaagaatacaactgagagctttgtccctgtgcttaaacaaatatccacgtggactaaattcaccaaggaagagacgtcctccctggccacagtcttcctggagagtgtggaaagcatgacactggcatctttttggaaaccctcagcaaatatcactccggctgttcggacggaatacttagacattgagagcaaagttatcaacaaagaatgcagtgaagagaatgtgacgttggacttggtagccaagggggataagatgaagatcgggtgttccacaattgaggaatctgaatccacagagaccactggtgtggcttttgtctcctttgtgggcatggaatcggttttaaatgagcgcttcttcaaagaccaccaggctcccttgaccacctctgagatcaagctgaagatgaattctcgagtcgttgggggcataatgactggagagaagaaagacggcttctcagatccaatcatctacactctggagaacattcagccaaagcagaagtttgagaggcccatctgtgtttcctggagcactgatgtgaagggtggaagatggacatcctttggctgtgtgatcctggaagcttctgagacatataccatctgcagctgtaatcagatggcaaatcttgccgttatcatggcgtctggggagctcacgatggacttttccttgtacatcattagccatgtaggcattatcatctccttggtgtgcctcgtcttggccatcgccacctttctgctgtgtcgctccatccgaaatcacaacacctacctccacctgcacctctgcgtgtgtctcctcttggcgaagactctcttcctcgccggtatacacaagactgacaacaagatgggctgcgccatcatcgcgggcttcctgcactaccttttccttgcctgcttcttctggatgctggtggaggctgtgatactgttcttgatggtcagaaacctgaaggtggtgaattacttcagctctcgcaacatcaagatgctgcacatctgtgcctttggttatgggctgccgatgctggtggtggtgatctctgccagtgtgcagccacagggctatggaatgcataatcgctgctggctgaatacagagacagggttcatctggagtttcttggggccagtttgcacagttatagtggtaagcaaatactacaacagcctggcgaagtgtgttctgaaggaggagcaaggagacctgcgagatctggaatttccagggacgtgtgcagctgagaggatcaactcccttctcctgacctggaccttgtggatcctgaggcagaggctttccagtgttaatgccgaagtctcaacgctaaaagacaccaggttactgaccttcaaggcctttgcccagctcttcatcctgggctgctcctgggtgctgggcatttttcagattggacctgtggcaggtgtcatggcttacctgttcaccatcatcaacagcctgcagggggccttcatcttcctcatccactgtctgctcaacggccaggtacgagaagaatacaagaggtggatcactgggaagacgaagcccagctcccagtcccagacctcaaggatcttgctgtcctccatgccatccgcttccaagacgggttaaagtcctttcttgctttcaaatatgctatggagccacagttgaggacagtagtttcctgcaggagcctaccctgaaatctcttctcagcttaacatggaaatgaggatcccaccagccccagaaccctctggggaagaatgttgggggcggtcttcctgtggttgtatgcactgatgagaaatcaggcgtttctgctccaaacgaccattttatcttcgtgctctgcaacttcttcaattccagagtttctgagaacagacccaaattcaatggcatgaccaagaacacctggctaccattttgttttctcctgcccttgttggtgcatggttctaagcatgcccctccagagcctatcatacgcctgatacagagaacctctcaataaatgatttgtcgcctgtctgactgatttaccctag

SEQ ID NO: 9325 - DNA, 2670 bp, Homo sapiens
gaatgacagaactacagcataatgcgtggcttcaacctgctcctcttctggggatgttgtgttatgcacagctgggaagggcacataagacccacacggaaaccaaacacaaagggtaataactgtagagacagtaccttgtgcccagcttatgccacctgcaccaatacagtggacagttactattgcgcttgcaaacaaggcttcctgtccagcaatgggcaaaatcacttcaaggatccaggagtgcgatgcaaagatattgatgaatgcactgaaatgtgccccatcaattcaacatgcaccaacactcctgggagctacttttgcacctgccaccctggctttgcaccaagcaatggacagttgaatttcacagaccaaggagtggaatgtagagatattgatgagtgccgccaagatccatcaacctgtggtcctaattctatctgcaccaatgccctgggctcctacagctgtggctgcattgcaggctttcatcccaatccagaaggctcccagaaagatggcaacttcagctgccaaagggttctcttcaaatgtaaggaagatgtgatacccgataataagcagatccagcaatgccaagagggaaccgcagtgaaacctgcatatgtctccttttgtgcacaaataaataacatcttcagcgttctggacaaagtgtgtgaaaataaaacgaccgtagtttctctgaagaatacaactgagagctttgtccctgtgcttaaacaaatatccacgtggactaaattcaccaaggaagagacgtcctccctggccacagtcttcctggagagtgtggaaagcatgacactggcatctttttggaaaccctcagcaaatatcactccggctgttcggacggaatacttagacattgagagcaaagttatcaacaaagaatgcagtgaagagaatgtgacgttggacttggtagccaagggggataagatgaagatcgggtgttccacaattgaggaatctgaatccacagagaccactggtgtggcttttgtctcctttgtgggcatggaatcggttttaaatgagcgcttcttcaaagaccaccaggctcccttgaccacctctgagatcaagctgaagatgaattctcgagtcgttgggggcataatgactggagagaagaaagacggcttctcagatccaatcatctacactctggagaacattcagccaaagcagaagtttgagaggcccatctgtgtttcctggagcactgatgtgaagggtggaagatggacatcctttggctgtgtgatcctggaagcttctgagacatataccatctgcagctgtaatcagatggcaaatcttgccgttatcatggcgtctggggagctcacgatggacttttccttgtacatcattagccatgtaggcattatcatctccttggtgtgcctcgtcttggccatcgccacctttctgctgtgtcgctccatccgaaatcacaacacctacctccacctgcacctctgcgtgtgtctcctcttggcgaagactctcttcctcgccggtatacacaagactgacaacaagatgggctgcgccatcatcgcgggcttcctgcactaccttttccttgcctgcttcttctggatgctggtggaggctgtgatactgttcttgatggtcagaaacctgaaggtggtgaattacttcagctctcgcaacatcaagatgctgcacatctgtgcctttggttatgggctgccgatgctggtggtggtgatctctgccagtgtgcagccacagggctatggaatgcataatcgctgctggctgaatacagagacagggttcatctggagtttcttggggccagtttgcacagttatagtgatcaactcccttctcctgacctggaccttgtggatcctgaggcagaggctttccagtgttaatgccgaagtctcaacgctaaaagacaccaggttactgaccttcaaggcctttgcccagctcttcatcctgggctgctcctgggtgctgggcatttttcagattggacctgtggcaggtgtcatggcttacctgttcaccatcatcaacagcctgcagggggccttcatcttcctcatccactgtctgctcaacggccaggtacgagaagaatacaagaggtggatcactgggaagacgaagcccagctcccagtcccagacctcaaggatcttgctgtcctccatgccatccgcttccaagacgggttaaagtcctttcttgctttcaaatatgctatggagccacagttgaggacagtagtttcctgcaggagcctaccctgaaatctcttctcagcttaacatggaaatgaggatcccaccagccccagaaccctctggggaagaatgttgggggcggtcttcctgtggttgtatgcactgatgagaaatcaggcgtttctgctccaaacgaccattttatcttcgtgctctgcaacttcttcaattccagagtttctgagaacagacccaaattcaatggcatgaccaagaacacctggctaccattttgttttctcctgcccttgttggtgcatggttctaagcatgcccctccagagcctatcatacgcctgatacagagaacctctcaataaatgatttgtcgcctgtctgactg

SEQ ID NO: 9326 - DNA, 2556 bp, Homo sapiens
gaatgacagaactacagcataatgcgtggcttcaacctgctcctcttctggggatgttgtgttatgcacagctgggaagggcacataagacccacacggaaaccaaacacaaagggtaataactgtagagacagtaccttgtgcccagcttatgccacctgcaccaatacagtggacagttactattgcgcttgcaaacaaggcttcctgtccagcaatgggcaaaatcacttcaaggatccaggagtgcgatgcaaagatattgatgaatgttctcaaagcccccagccctgtggtcctaactcatcctgcaaaaacctgtcagggaggtacaagtgcagctgtttagatggtttctcttctcccactggaaatgactgggtcccaggaaagccgggcaatttctcctgtactgatatcaatgagtgcctcaccagcagggttctcttcaaatgtaaggaagatgtgatacccgataataagcagatccagcaatgccaagagggaaccgcagtgaaacctgcatatgtctccttttgtgcacaaataaataacatcttcagcgttctggacaaagtgtgtgaaaataaaacgaccgtagtttctctgaagaatacaactgagagctttgtccctgtgcttaaacaaatatccacgtggactaaattcaccaaggaagagacgtcctccctggccacagtcttcctggagagtgtggaaagcatgacactggcatctttttggaaaccctcagcaaatatcactccggctgttcggacggaatacttagacattgagagcaaagttatcaacaaagaatgcagtgaagagaatgtgacgttggacttggtagccaagggggataagatgaagatcgggtgttccacaattgaggaatctgaatccacagagaccactggtgtggcttttgtctcctttgtgggcatggaatcggttttaaatgagcgcttcttcaaagaccaccaggctcccttgaccacctctgagatcaagctgaagatgaattctcgagtcgttgggggcataatgactggagagaagaaagacggcttctcagatccaatcatctacactctggagaacattcagccaaagcagaagtttgagaggcccatctgtgtttcctggagcactgatgtgaagggtggaagatggacatcctttggctgtgtgatcctggaagcttctgagacatataccatctgcagctgtaatcagatggcaaatcttgccgttatcatggcgtctggggagctcacgatggacttttccttgtacatcattagccatgtaggcattatcatctccttggtgtgcctcgtcttggccatcgccacctttctgctgtgtcgctccatccgaaatcacaacacctacctccacctgcacctctgcgtgtgtctcctcttggcgaagactctcttcctcgccggtatacacaagactgacaacaagatgggctgcgccatcatcgcgggcttcctgcactaccttttccttgcctgcttcttctggatgctggtggaggctgtgatactgttcttgatggtcagaaacctgaaggtggtgaattacttcagctctcgcaacatcaagatgctgcacatctgtgcctttggttatgggctgccgatgctggtggtggtgatctctgccagtgtgcagccacagggctatggaatgcataatcgctgctggctgaatacagagacagggttcatctggagtttcttggggccagtttgcacagttatagtgatcaactcccttctcctgacctggaccttgtggatcctgaggcagaggctttccagtgttaatgccgaagtctcaacgctaaaagacaccaggttactgaccttcaaggcctttgcccagctcttcatcctgggctgctcctgggtgctgggcatttttcagattggacctgtggcaggtgtcatggcttacctgttcaccatcatcaacagcctgcagggggccttcatcttcctcatccactgtctgctcaacggccaggtacgagaagaatacaagaggtggatcactgggaagacgaagcccagctcccagtcccagacctcaaggatcttgctgtcctccatgccatccgcttccaagacgggttaaagtcctttcttgctttcaaatatgctatggagccacagttgaggacagtagtttcctgcaggagcctaccctgaaatctcttctcagcttaacatggaaatgaggatcccaccagccccagaaccctctggggaagaatgttgggggcggtcttcctgtggttgtatgcactgatgagaaatcaggcgtttctgctccaaacgaccattttatcttcgtgctctgcaacttcttcaattccagagtttctgagaacagacccaaattcaatggcatgaccaagaacacctggctaccattttgttttctcctgcccttgttggtgcatggttctaagcatgcccctccagagcctatcatacgcctgatacagagaacctctcaataaatgatttgtcgcctgtc

SEQ ID NO: 9327 - DNA, 2501 bp, Homo sapiens
aaaagtttcttttctttgaatgacagaactacagcataatgcgtggcttcaacctgctcctcttctggggatgttgtgttatgcacagctgggaagggcacataagacccacacggaaaccaaacacaaagggtaataactgtagagacagtaccttgtgcccagcttatgccacctgcaccaatacagtggacagttactattgcgcttgcaaacaaggcttcctgtccagcaatgggcaaaatcacttcaaggatccaggagtgcgatgcaaagatattgatgaatgttctcaaagcccccagccctgtggtcctaactcatcctgcaaaaacctgtcagggaggtacaagtgcagctgtttagatggtttctcttctcccactggaaatgactgggtcccaggaaagccgggcaatttctcctgtactgatatcaatgagtgcctcaccagcagcgtctgccctgagcattctgactgtgtcaactccatgggaagctacagttgcagctgtcaagttggattcatctctagaaactccacctgtgaagacgtggatgaatgtgcagatccaagagcttgcccagagcatgcaacttgtaataacactgttggaaactactcttgtttctgcaacccaggatttgaatccagcagtggccacttgagtttccagggtctcaaagcatcgtgtgaagatattgatgaatgcactgaaatgtgccccatcaattcaacatgcaccaacactcctgggagctacttttgcacctgccaccctggctttgcaccaagcaatggacagttgaatttcacagaccaaggagtggaatgtagagatattgatgagtgccgccaagatccatcaacctgtggtcctaattctatctgcaccaatgccctgggctcctacagctgtggctgcattgcaggctttcatcccaatccagaaggctcccagaaagatggcaacttcagctgccaaagggttctcttcaaatgtaaggaagatgtgatacccgataataagcagatccagcaatgccaagagggaaccgcagtgaaacctgcatatgtctccttttgtgcacaaataaataacatcttcagcgttctggacaaagtgtgtgaaaataaaacgaccgtagtttctctgaagaatacaactgagagctttgtccctgtgcttaaacaaatatccacgtggactaaattcaccaaggaagagacgtcctccctggccacagtcttcctggagagtgtggaaagcatgacactggcatctttttggaaaccctcagcaaatatcactccggctgttcggacggaatacttagacattgagagcaaagttatcaacaaagaatgcagtgaagagaatgtgacgttggacttggtagccaagggggataagatgaagatcgggtgttccacaattgaggaatctgaatccacagagaccactggtgtggcttttgtctcctttgtgggcatggaatcggttttaaatgagcgcttcttcaaagaccaccaggctcccttgaccacctctgagatcaagctgaagatgaattctcgagtcgttgggggcataatgactggagagaagaaagacggcttctcagatccaatcatctacactctggagaacattcagccaaagcagaagtttgagaggcccatctgtgtttcctggagcactgatgtgaagggtggaagatggacatcctttggctgtgtgatcctggaagcttctgagacatataccatctgcagctgtaatcagatggcaaatcttgccgttatcatggcgtctggggagctcacgatgggctgcgccatcatcgcgggcttcctgcactaccttttccttgcctgcttcttctggatgctggtggaggctgtgatactgttcttgatggtcagaaacctgaaggtggtgaattacttcagctctcgcaacatcaagatgctgcacatctgtgcctttggttatgggctgccgatgctggtggtggtgatctctgccagtgtgcagccacagggctatggaatgcataatcgctgctggctgaatacagagacagggttcatctggagtttcttggggccagtttgcacagttatagtgatcaactcccttctcctgacctggaccttgtggatcctgaggcagaggctttccagtgttaatgccgaagtctcaacgctaaaagacaccaggttactgaccttcaaggcctttgcccagctcttcatcctgggctgctcctgggtgctgggcatttttcagattggacctgtggcaggtgtcatggcttacctgttcaccatcatcaacagcctgcagggggccttcatcttcctcatccactgtctgctcaacggccaggtacgagaagaatacaagaggtggatcactgggaagacgaagcccagctcccagtcccagacctcaaggatcttgctgtcctccatgccatccgcttccaagacgggt

SEQ ID NO: 9328 - DNA, 2398 bp, Homo sapiens
accccgtccagcttcatccgcagaggagcctcggccaggcttgccagggcgcccccagcccctccccaggccgcgagcgcccctgccgcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccagtgcaaggcatcacgggttgttagcatcggcacgtcagcctggggtctgtcactatggaactaaactggcctgctgctacggctggagaagaaacagcaagggagtctgtgaagctacatgcgaacctggatgtaagtttggtgagtgcgtgggaccaaacaaatgcagatgctttccaggatacaccgggaaaacctgcagtcaagatgtgaatgagtgtggaatgaaaccccggccatgccaacacagatgtgtgaatacacacggaagctacaagtgcttttgcctcagtggccacatgctcatgccagatgctacgtgtgtgaactctaggacatgtgccatgataaactgtcagtacagctgtgaagacacagaagaagggccacagtgcctgtgtccatcctcaggactccgcctggccccaaatggaagagactgtctagatattgatgaatgtgcctctggtaaagtcatctgtccctacaatcgaagatgtgtgaacacatttggaagctactactgcaaatgtcacattggtttcgaactgcaatatatcagtggacgatatgactgtatagatataaatgaatgtactatggatagccatacgtgcagccaccatgccaattgcttcaatacccaagggtccttcaagtgtaaatgcaagcagggatataaaggcaatggacttcggtgttctgctatccctgaaaattctgtgaaggaagtcctcagagcacctggtaccatcaaagacagaatcaagaagttgcttgctcacaaaaacagcatgaaaaagaaggcaaaaattaaaaatgttaccccagaacccaccaggactcctacccctaaggtgaacttgcagcccttcaactatgaagagatagtttccagaggcgggaactctcatggaggtaaaaaagggaatgaagagaaaatgaaagaggggcttgaggatgagaaaagagaagagaaagccctgaagaatgacatagaggagcgaagcctgcgaggagatgtgtttttccctaaggtgaatgaagcaggtgaattcggcctgattctggtccaaaggaaagcgctaacttccaaactggaacataaagatttaaatatctcggttgactgcagcttcaatcatgggatctgtgactggaaacaggatagagaagatgattttgactggaatcctgctgatcgagataatgctattggcttctatatggcagttccggccttggcaggtcacaagaaagacattggccgattgaaacttctcctacctgacctgcaaccccaaagcaacttctgtttgctctttgattaccggctggccggagacaaagtcgggaaacttcgagtgtttgtgaaaaacagtaacaatgccctggcatgggagaagaccacgagtgaggatgaaaagtggaagacagggaaaattcagttgtatcaaggaactgatgctaccaaaagcatcatttttgaagcagaacgtggcaagggcaaaaccggcgaaatcgcagtggatggcgtcttgcttgtttcaggcttatgtccagatagccttttatctgtggatgactgaatgttactatctttatatttgactttgtatgtcagttccctggtttttttgatattgcatcataggacctctggcattttagaattactagctgaaaaattgtaatgtaccaacagaaatattattgtaagatgcctttcttgtataagatatgccaatatttgctttaaatatcatatcactgtatcttctcagtcatttctgaatctttccacattatattataaaatatggaaatgtcagtttatctcccctcctcagtatatctgatttgtataagtaagttgatgagcttctctctacaacatttctagaaaatagaaaaaaaagcacagagaaatgtttaactgtttgactcttatgatacttcttggaaactatgacatcaaagatagacttttgcctaagtggcttagctgggtctttcatagccaaacttgtatatttaaattctttgtaataataatatccaaatcatc

SEQ ID NO: 9329 - DNA, 2385 bp, Homo sapiens
ccgcagaggagcctcggccaggcttgccagggcgcccccagcccctccccaggccgcgagcgcccctgccgcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccagtgcaaggcatcacgggttgttagcatcggcacgtcagcctggggtctgtcactatggaactaaactggcctgctgctacggctggagaagaaacagcaagggagtctgtgaagctacatgcgaacctggatgtaagtttggtgagtgcgtgggaccaaacaaatgcagatgctttccaggatacaccgggaaaacctgcagtcaagatgtgaatgagtgtggaatgaaaccccggccatgccaacacagatgtgtgaatacacacggaagctacaagtgcttttgcctcagtggccacatgctcatgccagatgctacgtgtgtgaactctaggacatgtgccatgataaactgtcagtacagctgtgaagacacagaagaagggccacagtgcctgtgtccatcctcaggactccgcctggccccaaatggaagagactgtctagatattgatgaatgtgcctctggtaaagtcatctgtccctacaatcgaagatgtgtgaacacatttggaagctactactgcaaatgtcacattggtttcgaactgcaatatatcagtggacgatatgactgtatagatataaatgaatgtactatggatagccatacgtgcagccaccatgccaattgcttcaatacccaagggtccttcaagtgtaaatgcaagcagggatataaaggcaatggacttcggtgttctgctatccctgaaaattctgtgaaggaagtcctcagagcacctggtaccatcaaagacagaatcaagaagttgcttgctcacaaaaacagcatgaaaaagaaggcaaaaattaaaaatgttaccccagaacccaccaggactcctacccctaaggtgaacttgcagcccttcaactatgaagagatagtttccagaggcgggaactctcatggaggtaaaaaagggaatgaagagaaaatgaaagaggggcttgaggatgagaaaagagaagagaaagccctgaagaatgacatagaggagcgaagcctgcgaggagatgtgtttttccctaaggtgaatgaagcaggtgaattcggcctgattctggtccaaaggaaagcgctaacttccaaactggaacataaagcagatttaaatatctcggttgactgcagcttcaatcatgggatctgtgactggaaacaggatagagaagatgattttgactggaatcctgctgatcgagataatgctattggcttctatatggcagttccggccttggcaggtcacaagaaagacattggccgattgaaacttctcctacctgacctgcaaccccaaagcaacttctgtttgctctttgattaccggctggccggagacaaagtcgggaaacttcgagtgtttgtgaaaaacagtaacaatgccctggcatgggagaagaccacgagtgaggatgaaaagtggaagacagggaaaattcagttgtatcaaggaactgatgctaccaaaagcatcatttttgaagcagaacgtggcaagggcaaaaccggcgaaatcgcagtggatggcgtcttgcttgtttcaggcttatgtccagatagccttttatctgtggatgactgaatgttactatctttatatttgactttgtatgtcagttccctggtttttttgatattgcatcataggacctctggcattttagaattactagctgaaaaattgtaatgtaccaacagaaatattattgtaagatgcctttcttgtataagatatgccaatatttgctttaaatatcatatcactgtatcttctcagtcatttctgaatctttccacattatattataaaatatggaaatgtcagtttatctcccctcctcagtatatctgatttgtataagtaagttgatgagcttctctctacaacatttctagaaaatagaaaaaaaagcacagagaaatgtttaactgtttgactcttatgatacttcttggaaactatgacatcaaagatagacttttgcctaagtggcttagctgggtctttcatagccaaacttgtatatttaaattctttgtaataataatatccaaatcatca

SEQ ID NO: 9330 - DNA, 1530 bp, Homo sapiens
ctgcaccaagctggccctgcacggctgcaagggaggctcctgtggacaggccaggcaggtgggcctcaggaggtgcctccaggcggccagtgggcctgaggccccagcaagggctagggtccatctccagtcccaggacacagcagcggccaccatggccacgcctgggctccagcagcatcagcccccaggaccggggaggcacaggtggcccccaccacccggaggagcagctcctgcccctgtccgggggatgactgattctcctccgccaggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcgtcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaaaccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtg

SEQ ID NO: 9331 - DNA, 1282 bp, Homo sapiens
ggcgcgtgcgcgccccggatccggcggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcgtcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaaaccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtga

SEQ ID NO: 9332 - DNA, 2125 bp, Homo sapiens
agatgcaaagccggtggggacctgccaagaagccagcccacaaggccatggactcctccacgccatcagctggagcagtgggcagccccaggaagggagacgggagcggccaggggaagggcgaggggtcccccgggcgacccccgaggctcaggcgcccggactccagtcctgggcctccgttttccacccttgaacaagcggcttccacctgtgagccagctgcctcctctgaaaatggaagcccctcaactcagagggtgtcgctctgggacgtgggtcaggggccggagcaggcagggagaggtgagaggaaaggctggggaccctcacttctccctgcccaaaccctcgctcgggagcagacggctcctctgcccgcaggcacccctgcctggcagctccctccagcccccgtcgggtccgggacgtcctctgatgggaaggttccaccacatccgtggctgacagagccagcccgtccgaggccggggggcgctcggggtaaacaggaagccccatccctcccgcactctgcttcactccctcctcctgcacctcctgcagcccggctcccgcggccgcgcctggtgcccctctgtctcgcgccacctgagatgcccaggctggcctctgccaggggcttagtctgccctctcctggggcttcagaggccaaaagcaccctggtgaggggtccgggaggcccgggagggcccggggggctctgccaggcccctccacgcctctctgcccagccagcacgctctgggaagcagcccccaggaccggggaggcacaggtggcccccaccacccggaggagcagctcctgcccctgtccgggggatgactgattctcctccgccaggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcgtcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaaaccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtga

SEQ ID NO: 9333 - DNA, 1529 bp, Homo sapiens
ccaagctggccctgcacggctgcaagggaggctcctgtggacaggccaggcaggtgggcctcaggaggtgcctccaggcggccagtgggcctgaggccccagcaagggctagggtccatctccagtcccaggacacagcagcggccaccatggccacgcctgggctccagcagcatcagcagcccccaggaccggggaggcacaggtggcccccaccacccggaggagcagctcctgcccctgtccgggggatgactgattctcctccgccaggccacccagaggagaaggccaccccgcctggaggcacaggccatgaggggctctcaggaggtgctgctgatgtggcttctggtgttggcagtgggcggcacagagcacgcctaccggcccggccgtagggtgtgtgctgtccgggctcacggggaccctgtctccgagtcgttcgtgcagcgtgtgtaccagcccttcctcaccacctgcgacgggcaccgggcctgcagcacctaccgaaccatctataggaccgcctaccgccgcagccctgggctggcccctgccaggcctcgctacgcgtgctgccccggctggaagaggaccagcgggcttcctggggcctgtggagcagcaatatgccagccgccatgccggaacggagggagctgtgtccagcctggccgctgccgctgccctgcaggatggcggggtgacacttgccagtcagatgtggatgaatgcagtgctaggaggggcggctgtccccagcgctgcgtcaacaccgccggcagttactggtgccagtgttgggaggggcacagcctgtctgcagacggtacactctgtgtgcccaagggagggccccccagggtggcccccaacccgacaggagtggacagtgcaatgaaggaagaagtgcagaggctgcagtccagggtggacctgctggaggagaagctgcagctggtgctggccccactgcacagcctggcctcgcaggcactggagcatgggctcccggaccccggcagcctcctggtgcactccttccagcagctcggccgcatcgactccctgagcgagcagatttccttcctggaggagcagctggggtcctgctcctgcaagaaagactcgtgactgcccagcgccccaggctggactgagcccctcacgccgccctgcagcccccatgcccctgcccaacatgctgggggtccagaaaccacctcggggtgactgagcggaaggccaggcagggccttcctcctcttcctcctccccttcctcgggaggctccccagaccctggcatgggatgggctgggatcttctctgtgaatccacccctggctacccccaccctggctaccccaacggcatcccaaggccaggtgggccctcagctgagggaaggtacgagctccctgctggagcctgggacccatggcacaggccaggcagcccggaggctgggtggggcctcagtgggggctgctgcctgacccccagcacaataaaaatgaaacgtga

SEQ ID NO: 9334 - DNA, 1310 bp, Homo sapiens
ccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaa

SEQ ID NO: 9335 - DNA, 1312 bp, Homo sapiens
gctgcttctgctgaggctggtctgcttgaagcctcccaggagaaagaagccaggtgggaatggagagagagaggaagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaa

SEQ ID NO: 9336 - DNA, 1312 bp, Homo sapiens
gctgcttctgctgaggctggtctgcttgaagcctcccaggagaaagaagccaggtgggaatggagagagagaggaagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaagcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaa

SEQ ID NO: 9337 - DNA, 825 bp, Homo sapiens
gggaatggagagagagaggaagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtgggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcct

SEQ ID NO: 9338 - DNA, 1312 bp, Homo sapiens; identical to SEQ ID NO: 9335

SEQ ID NO: 9339 - DNA, 1310 bp, Homo sapiens; identical to SEQ ID NO: 9334

SEQ ID NO: 9340 - DNA, 1312 bp, Homo sapiens
gctgcttctgctgaggctggtctgcttgaagcctcccaggagaaagaagccaggtgggaatggagagagagaggaagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaacggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaa

SEQ ID NO: 9341 - DNA, 825 bp, Homo sapiens; identical to SEQ ID NO: 9337

SEQ ID NO: 9342 - DNA, 825 bp, Homo sapiens; identical to SEQ ID NO: 9337

SEQ ID NO: 9343 - DNA, 825 bp, Homo sapiens
gggaatggagagagagaggaagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaagcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtgggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcct

SEQ ID NO: 9344 - DNA, 1312 bp, Homo sapiens; identical to SEQ ID NO: 9335

SEQ ID NO: 9345 - DNA, 1309 bp, Homo sapiens
gctgcttctgctgaggctggtctgcttgaagcctcccaggagaaagaagccaggtgggaatggagagagagaggaagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcaattccttaacaaatgcaaccaccaacacccagatctctctctctctttattttcagtttttttgctgttatccagataattaataaaaaccaaccacgcaaaa

SEQ ID NO: 9346 - DNA, 1310 bp, Homo sapiens
ccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaacggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaa

SEQ ID NO: 9347 - DNA, 1310 bp, Homo sapiens
ccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaagcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaa

SEQ ID NO: 9348 - DNA, 1277 bp, Homo sapiens
tgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcggaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcaattccttaacaaatgcaaccaccaacacccagatctctctctctctttattttcagtttttttgctgttatccagataattaataaaaaccaaccacgcaaaa

SEQ ID NO: 9349 - DNA, 1310 bp, Homo sapiens; identical to SEQ ID NO: 9334

SEQ ID NO: 9350 - DNA, 1312 bp, Homo sapiens
gctgcttctgctgaggctggtctgcttgaagcctcccaggagaaagaagccaggtgggaatggagagagagaggaagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcagaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaa

SEQ ID NO: 9351 - DNA, 825 bp, Homo sapiens; identical to SEQ ID NO: 9337

SEQ ID NO: 9352 - DNA, 1310 bp, Homo sapiens
ccaggcccacccaccagtctgagctgcttctgctgaggctggtctgcttgaagcctcccaggagaaagaagccagcctgtagggtccagcgtcaaagcgaatcatggggtccagggctgagctgtgcactctcttaggcggattctccttcctcctgctactgataccaggcgagggggccaagggtggatccctcagagagagtcagggagtctgctccaagcagacactggtggtcccgctccactacaacgagtcctacagccaaccagtgtacaagccctacctgaccttgtgcgctgggaggcgcatctgcagcacttacaggaccatgtaccgcgttatgtggcgggaggtgaggcgggaggttcagcagacccatgcagtgtgctgccagggctggaagaagcggcacccgggggcgctcacctgtgaagccatctgcgccaagccttgcctgaacggaggcgtctgcgttaggcctgaccagtgcgagtgcgcccccggctggggagggaagcactgtcatgtggacgtggatgaatgtaggaccagcatcaccctctgctcgcaccattgttttaatacggcaggcagcttcacctgcggctgcccccatgacctagtgctaggcgtggacgggcgcacctgcatggaggggtccccagagcccccaaccagtgccagcatactcagcgtggccgttcgggaggcagaaaaagatgagcgcgctctgaagcaggagattcacgagctgcgagggcgcctggagcggctggagcagtgggccggtcaggctggggcctgggtcagagcggtgctgcccgtgccgcctgaagagctgcagccagaacaggtggctgagctgtggggccggggtgaccggatcgaatctctcagcgaccaggtgctgctgctggaggagaggctaggtgcctgctcctgtgaggacaacagcctgggcctcggcgtcaatcatcgataagaagcctctacagcacccctgccccctaatttatacagaaaccggacccactaatcctctgggattggccgactgtgagctgcagataaggctatcagccaccaaagagcaatgaacaatggaaacttcagagagctgaagaaagggggaggcctgtgttcttggcctgcccctgagtcttctggctgggggcaggttgcctgggcaagaactgcttcttcaattccttaacaaatgcaaccaccaacacccagatctctctctctctttattttcagtttttttgctgttatccagataattaataaaaaccaaccacgcaaaa

SEQ ID NO: 9353 - DNA, 7097 bp, Homo sapiens
ttaggggcagaaaaacatttgtaataattaatggctttgagagacacaaggctttgtttgccccagagtattagttaacccacctagtgctcctaatcatacaatattaaggattgggagggacattcattgcctcactctctatttgtttcaccttctgtaaaattggtagaataatagtacccacttcatagcattgtatgatgattaaattggttaatatttttaaaatgcttagaacacagattgggcacataacagcaagcaccacatgtgtttataagataaattcctttgtgttgccttccgttaaagtttaaataagtaaataaataaataaatacttgcatgacattttgaagtctctctataacatctgagtaagtggcggctgcgacaatgctactggagttccagaatcgtgttggtgacaagattgttcaccagcatatggtgtggtgaaaactcactaatttggaattagttcagattattaagcctgaataggtgaaaatcctgaaatcaaggatctttggaactatttgaaatcagtattttatattttcctgttgtattcattaaagtgttgcaagtgttctatttgatggattaagtatatttaggatatacatgttcaatttgtgattttgtatacttaattggaacaagaaagctaataaaggttttgatatggacatctattcttttaagtaaacttcaatgaaaatatatgagtagagcatatagagatgtaaataatttgtggacacaccacagactgaaatagcaaatttaaaagaaattgttggaagaatcaagtgtttgtggaatgagtcctcctagtaaagttcctgctcttgtgaataattaagcctcatgtataattactatagcaaaaggaagcctaagaagtattagactctacttgtatttaaattacattttacataatttatgtgtatgaaaaatgttttaaatgcttattttcgtaagccatgagatagctcctttatattttaagaatttctgaattaatttgcttggattttattagtgcaaatggcagagctagcaattcctttttctgtgttcccattccatcctattcatccctcttttaggaaactctgaactctggattgtccttgtttacatacctgcctcctgcattggactatgtgtctctgagtgtagtatgactaattcatttgtttgtcaaggactctcaatgcatttgttgaacagcctaattagtaatgtctgcaacaatgacattttactgtatttaataaagctctgggaaagtaggatacacataagacaggtctaggtctaaattctttacagaaacttggatttttagttcggtttgaaatttgaagatgtgagtatatttatctcagtttcccaaaggacaagctaattggaattatcatcctctttcacttgattggatccccagaatgccatttacgcatgcagcaggattttataacagttttaaattctgtatatttgatgaagaggttttatatttttggattcaagcctctttttaaacttctacaatatggtttacaataattccttatatcctgcttttgaaatacatattacaactttttaagtttggaaggctatatttcaaggactgaagttacagtatactcaagtgatacacaagcctagcaccccactttccacatagtgttcgataaagattgataaactcgaaatcacagaccttttaattcttaagacaaatagcagcagaaagaaacatctttggcttatttctggtaaggtttttatgctctgtaaaacaaagaattgtattcatccgcgcagcacagattctattaaaaataaatgtgagagtcgttaatgtagtactgctcatttaccatcaaaattcacttttcaggaataatcccatcagtttaaattggatattggaatgagcattgattacatttaacttggtagcccaaaatttcttcatggggttttgaactcggcgggatttcaaaggttttaaaaatgagtttttgattttttttaaaaccctcaaatttcattacctttaaactaggtcgaaacggggcgcaagagattggattaacaccatagtaatacttattttgttcttaaccatttcagggcttcttgaaatagaggctgtatggtgtaatggaaaaaacagccttggaatctgggagcctgattcctggattcagtcccagttttgcgtgaccttgggcaagttactttacttctctgaatttccgtttcctcctctgcaaaatgaggatcgcaatagccaccttgcaaccttgactggagcgagcctcgcacaccccgcgccggcctggaggaagagcagccatgattacgccgccttcgctccgctacccgcttgcggctggcgccctcctccagcaggtgtaggcgctgccgcgctgccccacgcctttccgccgctcgcgggcctgcgcctcggcgtccccgaggaggccgctgcgggctgaggtagcgcaccggcctctcggcgtcccagtccggtcccgggcggagggaaagcgggcgacccacctccgaggcagaagccgaggcccggccccgccgagtgcggaggagcgcaggcagcccccgcccctcggccctccccccggccctcccggccctccctccgccccctccgccctcgcgcgccgcccgcccgggtcgccgcggggccgtggtgtacgtgcagagcgcgcagagcgagtggcgcccgtatgccctgcgctcctccacagcctgggccgggccgcccgggacgctgaggcggcggcggcggccgagggggccggtcttgcgctccccaggcccgcgcgcctgagcccaggttgccattcgccgcacaggccctattctctcagccctcggcggcgatgaggcgctgaggcggctgccggcgctgcgccggagcttaggactcggaagcggccgggccgagggcgtggggtgccggcctccctgaggcgagggtagcgggtgcatggcgcagtaacggcccctatctctctccccgctccccagcctcgggcgaggccgtccggccgctacccctcctgctcggccgccgcagtcgccgtcgccgccgccgccgccgccatggccaatgacagcggcgggcccggcgggccgagcccgagcgagcgagaccggcagtactgcgagctgtgcgggaagatggagaacctgctgcgctgcagccgctgccgcagctccttctactgctgcaaggagcaccagcgtcaggactggaagaagcacaagctcgtgtgccagggcagcgagggcgccctcggccacggagtgggcccacaccagcattccggccccgcgccgccggctgcagtgccgccgcccagggccggggcccgggagcccaggaaggcagcggcgcgccgggacaacgcctccggggacgcggccaagggaaaagtaaaggccaagcccccggccgacccagcggcggccgcgtcgccgtgtcgtgcggccgccggcggccagggctcggcggtggctgccgaagccgagcccggcaaggaggagccgccggcccgctcatcgctgttccaggagaaggcgaacctgtaccccccaagcaacacgcccggggatgcgctgagccccggcggcggcctgcggcccaacgggcagacgaagcccctgccggcgctgaagctggcgctcgagtacatcgtgccgtgcatgaacaagcacggcatctgtgtggtggacgacttcctcggcaaggagaccggacagcagatcggcgacgaggtgcgcgccctgcacgacaccgggaagttcacggacgggcagctggtcagccagaagagtgactcgtccaaggacatccgaggcgataagatcacctggatcgagggcaaggagcccggctgcgaaaccattgggctgctcatgagcagcatggacgacctgatacgccactgtaacgggaagctgggcagctacaaaatcaatggccggacgaaagccatggttgcttgttatccgggcaatggaacgggttatgtacgtcatgttgataatccaaatggagatggaagatgtgtgacatgtatatattatcttaataaagactgggatgccaaggtaagtggaggtatacttcgaatttttccagaaggcaaagcccagtttgctgacattgaacccaaatttgatagactgctgtttttctggtctgaccgtcgcaaccctcatgaagtacaaccagcatatgctacaaggtacgcaataactgtttggtattttgatgcagatgagagagcacgagctaaagtaaaatatctaacaggtgaaaaaggtgtgagggttgaactcaataaaccttcagattcggtcggtaaagacgtcttctagagcctttgatccagcaataccccacttcacctacaatattgttaactatttgttaacttgtgaatacgaataaatgggataaagaaaaatagacaaccagttcgcattttaataaggaaacagaaacaactttttgtgttgcatcaaacagaagattttgactgctgtgactttgtactgcatgatcaacttcaaatctgtgattgcttacaggaggaagataagctactaattgaaaatggtttttacatctggatatgaaataagtgccctgtgtagaatttttttcattcttatattttgccagatctgttatctagctgagttcatttcatctctcccttttttatatcaagtttgaatttgggataatttttctatattaggtacaatttatctaaactgaattgagaaaaaattacagtattattcctcaaaataacatcaatctatttttgtaaacctgttcatactattaaattttgccctaaaagacctcttaataatgattgttgccagtgactgatgattaattttattttacttaaaataagaaaaggagcactttaattacaactgaaaaatcagattgttttgtagtccttccttacactaatttgaactgttaaagattgctgctttttttttgacattgtcaataacgaaacctaattgtaaaacagtcaccatttactaccaataacttttagttaatgttttacaaggaaaaagacacaagaagagtttaaatttttttgttttgttttgtttttttgagacagtcttgctctgttacccaggctggaggggagtggtgcattcttggctcactgcaacctccgcctcccaggttcaagcaatcctcccacctcagcctcccaactagctgggactgcaggcacacaccaccatgcctgactaatttttgtatgtttagtagagacggggttttgccatgttgcctaggctggggtttaagttaaattttttaaaaaactaaagtgactggcactaagtgaacttgagattatcctcagcttcaagttcctaagataagggctttcttaagctttcaggtgtatgtatcctctagatgtagacaataatgtcccatttctaagtcttttccttttgcttctccttaaattgattgtacttccaaatttgctgttatgtttttttcctaatactgtgatctatctgatctgcagacaagaaccttgtctctgttgaagagcatcaaggggagattatgtacacattgaaactgaagtgtggtgttactgacggaatgtgcagtaactcctcagatatctgttaaggcatttcccagatgtgatgccagccttcttacctgtactgaaagatgcttagcttagaaaaaaacaaaacagatgcaaaatcagataattttattttgtttcatgggttttcttatttactttttaaacaaggaaggaatattagaaaatcacacaaggcctcacatacatgttatttaaagaatgaattgggacggatgtcttagacttcactttcctaggctttttagcaaaacctaaagggtggtatccatattttgcgtgaattatgggtgtaagaccttgcccacttaggttttctatctctgtccttgatcttctttgccaaaatgtgagtatacagaaattttctgtatatttcaacttaagacatttttagcatctgtatagtttgtattcaatttgagaccttttctatgggaagctcagtaatttttattaaaagattgccattgctattcatgtaaaacatggaaaaaaattgtgtagtgaagccaacagtggacttaggatgggattgaatgttcagtatagtgatctcacttaggagaatttgcaggagaaagtgatagtttattgttttttcctcgcccatattcagttttgttctacttcctccccttccttccagatgataacatcacatctctacagtaagtgcctctgccagcccaacccaggagcgcaagttgtctttgccatctggtctatagtacagtgcgcggcgttaggccacaactcaaaagcattatcttttttagggttagtagaaattgttttatgttgatgggaggtttgtttgattgtcaaaatgtacagccacagccttttaatttgggagcccctgttgtcattcaaatgtgtacctctacagttgtaaaaagtattagattctactatctgtgggttgtgcttgccagacaggtcttaaattgtatattttttggaaaagtttatatactctcttaggaatcattgtgaaaagatcaagaaatcaggatggccatttatttaatatccattcatttcatgttagtgggactattaacttgtcaccaagcaggactctatttcaaacaaaatttaaaactgtttgtggcctatatgtgtttaatcctggttaaagataaagcttcataatgctgtttttattcaacacattaaccagctgtaaaacacagacctttatcaagagtaggcaaagattttcaggattcatatacagatagactataaagtcatgtaatttgaaaagcagtgtttcattatgaaagagctctcaagttgcttgtaaagctaatctaattaaaaagatgtataaatgttgttgaaacatta

SEQ ID NO: 9354 - DNA, 419 bp, Homo sapiens
agggctcggcggtggctgccgaagccgagcccggcaaggaggagccgccggcccgctcatcgctgttccaggagaaggcgaacctgtaccccccaagcaacacgcccggggatgcgctgagccccggcggcggcctgcggcccaacgggcagacgaagcccctgccggcgctgaagctggcgctcgagtacatcgtgccgtgcatgaacaagcacggcatctgtgtggtggacgacttcctcggcaaggagaccggacagcagatcggcgacgaggtgcgcgccctgcacgacaccgggaagttcacggacggcagctggtcagccagaagagtgactcgtccaaggacatccgaggcgataagatcacctggatcgagggcaaggagcccggctgcgaaaccattgggctgctcatga

SEQ ID NO: 9355 - DNA, 2145 bp, Homo sapiens
acgtgcccaccgggcgaggcggggcggggcgtcgcgcgcggtgggggcggggtatggcgcgctgtgcggcgcagggcggctggcacaaacggcggcgccggggccggaggaaaaagctcgccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgc

SEQ ID NO: 9356 - DNA, 2088 bp, Homo sapiens
gctttcccctgcctgcctgtctctagtttctctcacatccctttttttttttcctttctctagccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgcaggacttggggttgaggtgagtcatggcctcttgctggcaatggggtgggaggagtacccccaagtcctctcactcctccagcctggaatgtgaagtgactccccaacccctttggccatggcaggcaccttttggactgggctgccactgcttgggcagagtaaaaggtgccaggaggagcatgggtgtggaagtcctgtcagccaagaaataaaagtttacctcagagctgc

SEQ ID NO: 9357 - DNA, 2709 bp, Homo sapiens
ccggagtctggccgcagtcgcggcagtggtggcttcccatccccaaaaggcgccctccgactccttgcgccgcactgctcgccgggccagtccggaaacgggtcgtggagctccgcaccactcccgctggttcccgaaggcagatcccttctcccgagagttgcgagaaactttcccttgtccccgacgctgcagcggctcgggtaccgtggcagccgcaggtttctgaaccccgggccacgctccccgcgcctcggcttcgcgctcgtgtagatcgttccctctctggttgcacgctggggatcccggacctcgattctgcgggcgagatgcccctgggacacatcatgaggctggacctggagaaaattgccctggagtacatcgtgccctgtctgcacgaggtgggcttctgctacctggacaacttcctgggcgaggtggtgggcgactgcgtcctggagcgcgtcaagcagctgcactgcaccggggccctgcgggacggccagctggcggggccgcgcgccggcgtctccaagcgacacctgcggggcgaccagatcacgtggatcgggggcaacgaggagggctgcgaggccatcagcttcctcctgtccctcatcgacaggctggtcctctactgcgggagccggctgggcaaatactacgtcaaggagaggtctaaggcaatggtggcttgctatccgggaaatggaacaggttatgttcgccacgtggacaaccccaacggtgatggtcgctgcatcacctgcatctactatctgaacaagaattgggatgccaagctacatggtgggatcctgcggatatttccagaggggaaatcattcatagcagatgtggagcccatttttgacagactcctgttcttctggtcagatcgtaggaacccacacgaagtgcagccctcttacgcaaccagatatgctatgactgtctggtactttgatgctgaagaaagggcagaagccaaaaagaaattcaggaatttaactaggaaaactgaatctgccctcactgaagactgaccgtgctctgaaatctgctggccttgttcattttagtaacggttcctgaattctcttaaattctttgagatccaaagatggcctcttcagtgacaacaatctccctgctacttcttgcatccttcacatccctgtcttgtgtgtggtacttcatgttttcttgccaagactgtgttgatcttcagatactctctttgccagatgaagttacttgctaactccagaaattcctgcagacatcctactcggccagcggtttacctgatagattcggtaatactatcaagagaagagcctaggagcacagcgagggaatgaaccttacttgcactttatgtatacttcctgatttgaaaggaggaggtttgaaaagaaaaaaatggaggtggtagatgccacagagaggcatcacggaagccttaacagcaggaaacagagaaatttgtgtcatctgaacaatttccagatgttcttaatccagggctgttggggtttctggagaattatcacaacctaatgacattaatacctctagaaagggctgctgtcatagtgaacaatttataagtgtcccatggggcagacactccttttttcccagtcctgcaacctggattttctgcctcagccccattttgctgaaaataatgactttctgaataaagatggcaacacaattttttctccattttcagttcttacctgggaacctaattccccagaagctaaaaaactagacattagttgttttggttgctttgttggaatggaatttaaatttaaatgaaaggaaaaatatatccctggtagttttgtgttaaccactgataactgtggaaagagctaggtctactgatatacaataaacatgtgtgcatcttgaacaatttgagaggggaggtggagttggaaatgtgggtgttcctgttttttttttttttttttttttagttttcctttttaatgagctcaccctttaacacaaaaaaagcaaggtgatgtattttaaaaaaggaagtggaaataaaaaaatctcaaagctatttgagttctcgtctgtccctagcagtctttcttcagctcacttggctctctagatccactgtggttggcagtatgaccagaatcatggaatttgctagaactgtggaagcttctactcctgcagtaagcacagatcgcactgcctcaataacttggtattgagcacgtattttgcaaaagctacttttcctagttttcagtattactttcatgttttaaaaatccctttaatttcttgcttgaaaatcccatgaacattaaagagccagaaatattttcctttgttatgtacggatatatatatatatagtcttccaagatagaagtttactttttcctcttctggttttggaaaatttccagataagacatgtcaccattaattctcaacgactgctctattttgttgtacggtaatagttatcaccttctaaattactatgtaatttattcacttattatgtttattgtcttgtatcctttctctggagtgtaagcacaatgaagacaggaattttgtatatttttaaccaatgcaacatactctcagcacctaaaatagtgccgggaacatagtaagggctcagtaaatacttgttgaataaactcagtctcc

SEQ ID NO: 9358 - DNA, 1917 bp, Homo sapiens
gagtctggccgcagtcgcggcagtggtggcttcccatccccaaaaggcgccctccgactccttgcgccgcactgctcgccgggccagtccggaaacgggtcgtggagctccgcaccactcccgctggttcccgaaggcagatcccttctcccgagatgcccctgggacacatcatgaggctggacctggagaaaattgccctggagtacatcgtgccctgtctgcacgaggtgggcttctgctacctggacaacttcctgggcgaggtggtgggcgactgcgtcctggagcgcgtcaagcagctgcactgcaccggggccctgcgggacggccagctggcggggccgcgcgccggcgtctccaagcgacacctgcggggcgaccagatcacgtggatcgggggcaacgaggagggctgcgaggccatcagcttcctcctgtccctcatcgacaggctggtcctctactgcgggagccggctgggcaaatactacgtcaaggagaggtctaaggcaatggtggcttgctatccgggaaatggaacaggttatgttcgccacgtggacaaccccaacggtgatggtcgctgcatcacctgcatctactatctgaacaagaattgggatgccaagctacatggtgggatcctgcggatatttccagaggggaaatcattcatagcagatgtggagcccatttttgacagactcctgttcttctggtcagatcgtaggaacccacacgaagtgcagccctcttacgcaaccagatatgctatgactgtctggtactttgatgctgaagaaagggcagaagccaaaaagaaattcaggaatttaactaggaaaactgaatctgccctcactgaagactgaccgtgctctgaaatctgctggccttgttcattttagtaacggttcctgaattctcttaaattctttgagatccaaagatggcctcttcagtgacaacaatctccctgctacttcttgcatccttcacatccctgtcttgtgtgtggtacttcatgttttcttgccaagactgtgttgatcttcagatactctctttgccagatgaagttacttgctaactccagaaattcctgcagacatcctactcggccagcggtttacctgatagattcggtaatactatcaagagaagagcctaggagcacagcgagggaatgaaccttacttgcactttatgtatacttcctgatttgaaaggaggaggtttgaaaagaaaaaaatggaggtggtagatgccacagagaggcatcacggaagccttaacagcaggaaacagagaaatttgtgtcatctgaacaatttccagatgttcttaatccagggctgttggggtttctggagaattatcacaacctaatgacattaatacctctagaaagggctgctgtcatagtgaacaatttataagtgtcccatggggcagacactccttttttcccagtcctgcaacctggattttctgcctcagccccattttgctgaaaataatgactttctgaataaagatggcaacacaattttttctccattttcagttcttacctgggaacctaattccccagaagctaaaaaactagacattagttgttttggttgctttgttggaatggaatttaaatttaaatgaaaggaaaaatatatccctggtagttttgtgttaaccactgataactgtggaaagagctaggtctactgatatacaataaacatgtgtgcatcttgaacaatttgagaggggaggtggagttggaaatgtgggtgttcctgttttttttttttttttttttttagttttcctttttaatgagctcaccctttaacacaaaaaaagcaaggtgatgtattttaaaaaaggaagtggaaataaaaaaatctcaaagct

SEQ ID NO: 9359 - DNA, 4551 bp, Homo sapiens
ccctaccgcccccaattccgccctgcccccgccgcggcggcgctagccgccactgagggaccgaccctataaaggccgctccgcgaggggtgcgcagcattcggcagagggcgcttcgacgggctgggctgtgcgcctgcgcagtgtgggtcgctcccgattccctgccccggccggccccgcctcggctccgcaccctcgccccgctctcagccgccgctctgccccgcagcagccagccccgtgtccggcagtatgttcagctgggtcagcaaggatgcccgccgcaagaaggagccggagctcttccagacggtggctgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctcggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcctgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagcgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggcccccaggttgagcaataagaaaccagaaccttgcggcccagtggcccgggccagttcaggccgcctccccctcctctgcctggggccattgagcccagcctccagggcccgggcgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtgcgaaagcttcgggtgcttccttgtcttttccaggggcagcagtcctgggccatcctcccctggtgtctgagggggtgatgccagcagggacagagtggcaaggcagccggggcaaggtgaccaaccctgcccagtcctgctctgctgggcagtagctgccccctcctactaagagggccaggcctgtagggaaaagggtttctggggtgatgcccccttccctgagcaaggtgggagctgagcagttcacttggggtggggaggggggaaacagttgggaggatgttgatagctgaggcctaggctggcacccctcagccacagacggatgagtgggcacctgcaggccctcggcactgggtggcatcaagtaaacaagggtttctgggctttggagccagactggctccttgctagccccaaggacggtttaagtacagggaagccgggcctctgaagacaaagcagatagcctgtgacaaacatgcaactaagggtggggccagtcaggcccaggtgatgtcacagatgggggactgtttataccagcagagggaagggtgactgattagtgacccttcataaaagggtgcagacttgaggtgccatgggtagaggctgctccagcccctctggcagaaggcaggacagaaacaagttcctgagggtttcagggacccagttgtgtgctccgagcctagctggtgtggtggtgtctggtcctatgaccagcacttgaggtgccagtggatgcttcagttgctgcagggctggccggccctccctgcgtcactcagctgccacctgtgggcattcaccctgtgccaggtggagctgcgctgtcacgatctgaggaagttcatgttcccccatttcacagagggagagtccgagactgaggactgccgaaataacaaaggtggtagaagcagatgcaaaccaggccgtccaactccagcgtgctttccatcaggttactaatccaaagcacacactaagaggaaaaaacggtagatccccccaaccccacccttagactgcagctgtactcagggctgagagacccacattaaaggttaaatgctgtcactcca

SEQ ID NO: 9360 - DNA, 3618 bp, Homo sapiens
aaaggggtctgtgtgtggccggggaggatggcgggggagtgagccccatggaacagccaggaactgataaaagatgaggggacaaagacagtgtgtgtctgggaagctgggctgagaggaggaggtgccgccgcctgggggtactccgatgcttccggggattccgagccagctggaggaccgcacgtggcgaacggcgggcgcggcgcgtagtcagggaaccagggtgcctgactgggtgtctcgtggagccatcccgcgggggtgtgggggggccacggtgccggaaggcgcgcggcccagaggccgtctccgccgaacgcccgctcctcgccttcctaaccgcagcactttcgcgagcctccctacgaggggcggggcgaaacagcagccagccccgtgtccggcagtatgttcagctgggtcagcaaggatgcccgccgcaagaaggagccggagctcttccagacggtggctgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctcggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcctgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgcagcgactgcgaccgtgggggagccaggtcgcccttttggcagctgctaggctgaggctgcatggacaggaacaccaggcaccctccgtgtgcttctgagctgaggttgcttcacgggaccgtggcttccttcctcacctggctctgcctcccccgtgctctcgggcgaagtgggttcttgtgccttcccctcccgggcccaggctccccgtgcgcgggccctgccctttcctcccgcgccccaccggctccgacgcgcaaccccgctcagcagtcacagaagcagggcccagccaccttggtctttttttgggagttcaggggagtaggagaatgtcttccagaaaaatacataagctagtttctgttctgtaaagtgatatctttcatacttgaccaaagttcccaataacttcccaaccactgttcaaaagctgtgatttttgtctccccttcccaccctccagccaaggagcagccctgcccagggggcattaggtgtgggtacccggggagcaccccgttcctggaccccagtgttgcatttcctggctgaggaagggtggtcatcccagctcctgccctaccctctcacttaactggagctttgggacgcaccctccacagtgggaggtggtggtgggtggcggtggcggggcctcacgacagcttggtgctggtaagaggaagcccgtggttctggctaggctctcatgtccagacagcggggaccaggggaaaacccagccccttctgtaatcccccttcatttcctaccttccttcctcctctgtttagcaaaggagggcagctcacttggatgtccttacaacgcccctggcccccaggttgagcaataagaaaccagaaccttgcggcccagtggcccgggccagttcaggccgcctccccctcctctgcctggggccattgagcccagcctccagggcccgggcgcgtttgcaggccagtggccactgtccgggctgtgatggcaccaaggcaggtggagcaccaggtaccacacagctgggcttcccaccaggctttcccgcgggggtctcagggagcttctccccagcgctgctcggagtctgcaggaactggccttgttctccttagcccgtcactccatacagtattaggtgaggatggatgcgggcgctgtccttgccgggaagtcactgttgaagttgcagtggcttgttcacacctgtgggaagagaagtgaagactttctccttgcattaaaaagtctgaactgtgcgaaa

SEQ ID NO: 9361 - DNA, 557 bp, Homo sapiens
gattctcaccagcctggacagccaaaggggtctgtgtgtggccggggaggatggcgggggagtgagccccatggaacagccaggaactggtaaggggagcagccagccccgtgtccggcagtatgttcagctgggtcagcaaggatgcccgccgcaagaaggagccggagctcttccagacggtggctgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtc

SEQ ID NO: 9362 - DNA, 1457 bp, Homo sapiens
gtgtggccggggaggatggcgggggagtgagccccatggaacagccaggaactgcagccagccccgtgtccggcagtatgttcagctgggtcagcaaggatgcccgccgcaagaaggagccggagctcttccagacggtggctgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctcggagagatctaccagaagattgagcgcgagcaccagatctcccctggggacttcccgagcctccgcaagatgcaggaactcctgcagacccaggacttcagcaagttccaggcgctgaagcccaagctgctggacgacgaggagttcgcgctggccaaccacctcatcaaggtcaagctggagggccacgagctgcctgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaagg

SEQ ID NO: 9363 - DNA, 534 bp, Homo sapiens
agattgaccgtacgccagcctcagagagagaaggcccaggcggggaggagtaaagcctccctgggagagccagccccgtgtccggcagtatgttcagctgggtcagcaaggatgcccgccgcaagaaggagccggagctcttccagacggtggctgaggggctgcggcagctgtacgcgcagaagctgctacccctggaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagca

SEQ ID NO: 9364 - DNA, 2023 bp, Homo sapiens
attcggcagagggcgcttcgacgggctgggctgtgcgcctgcgcagtgtgggtcgctcccgattccctgccccggccggccccgcctcggctccgcaccctcgccccgctctcagccgccgctctgccccgcagcagccagccccgtgtccggcagtatgttcagctgggtcagcaaggatgcccgccgcaagaaggagcactaccgcttccacgagttccactcgcccgcgctggaggacgctgacttcgacaacaagcctatggtgctcctcgtggggcagtacagcacgggcaagaccaccttcatccgacacctgatcgagcaggacttcccggggatgcgcatcgggcccgagcccaccaccgactccttcatcgccgtcatgcacggccccactgagggcgtggtgccgggcaacgcgctcgtggtggacccgcggcgccccttccgcaagctcaacgcgtttggcaacgctttcctcaacaggttcatgtgtgcccagctgcccaaccccgtcctggacagcatcagcatcatcgacacccccgggatcctgtctggagagaagcagcggatcagcagaggctatgactttgcagccgtcctggagtggttcgcggagcgtgtggaccgcatcatcctgctcttcgacgcccacaagctggacatctccgatgagttctcggaagtgatcaaggctctgaagaaccatgaggacaagatccgcgtggtgctgaacaaggcagaccagatcgagacgcagcagctgatgcgggtgtacggggccctcatgtggtccctgggcaagatcatcaacacccccgaggtggtcagggtctacatcggctccttctggtcccacccgctcctcatccccgacaaccgcaagctctttgaggccgaggagcaggacctcttcaaggacatccagtcactgccccgaaacgccgccctcaggaagctcaatgacctgatcaagcgggcacggctggccaaggttcacgcctacatcatcagctccctcaagaaagagatgcccaatgtctttggtaaagagagcaaaaagaaagagctggtgaacaacctcggagagatctaccagaagattgagcgcgagcaccagatctcccctggggacttcccgagcctccgcaagatgcaggaactcctgcagacccaggacttcagcaagttccaggcgctgaagcccaagctgctggacacggtggatgacatgctggccaacgacatcgcgcggctgatggtgatggtgcggcaggaggagtccctgatgccttcccaggtggtcaagggcggcgcctttgacggcaccatgaacgggccgttcgggcacggctacggcgagggggccggcgagggcatcgacgacgtggagtgggtggtgggcaaggacaagcccacctacgacgagatcttctacacgctgtcccctgtcaacggcaagatcacgggcgccaacgccaagaaggagatggtgaagtccaagctccccaacaccgtgctagggaagatctggaagctggccgacgtggacaaggacgggctgctggacgacgaggagttcgcgctggccaaccacctcatcaaggtcaagctggagggccacgagctgcctgccgacctgcccccgcacctggtgccgccctccaagcgcagacatgagtgatggcgcccggccccgcacctgccatttgcacgcccggccgggaggcagagacggggggaggggaagcctcaccatttctcaaggtccataaagactgagcggatgtttcctcgcctctcgaaaaggaaaaccaccatctttcttttaaggctgttcctgggcctggcgggggaggcaggggtgagaggatggaattgtgtgcacaagaactgtggctattttaatatataacgttagaggctgcgttctttgtcgccgcctcccctgtgtgccagccctgtgtgcacggcctctgccccccggcctttgctgtggctggagctggacagtgca

SEQ ID NO: 9365 - DNA, 3583 bp, Homo sapiens
ttttgaggggggcgcctcgtcccgcccctccctcctgtcctccctcccgtcctccccgctccgggccccacccggctcagacggctccggacgggaccgcgagcacaggccgctccgcgggcgcttcggatcctcgcgggaccccaccctctcccagcctgcccagcccgctgcagccgccagcgcgccccgtcggcagctctccatctgcacgtctctccgtgaaccccgtgagcggtgtgcagccaccatgttcagctggctgaagcggggcggggcacggggccagcagcccgaggccatccgcacggtgacctcggccctcaaggagctgtaccgcacgaagctgctgccgctggaggagcactaccgctttggggccttccactcgccggccctggaggacgcagacttcgacggcaagcccatggtgctggtggccggccagtacagcacgggcaagaccagcttcatccagtacctgctggagcaggaggtgcccggctcccgcgtggggcctgagcccaccaccgactgctttgtggccgtcatgcacggggacactgagggcaccgtgcccggcaacgccctcgtcgtggacccggacaagcccttccgcaaactcaaccctttcggaaacaccttcctcaacaggttcatgtgtgcccagctccctaatcaggtcctggagagcatcagcatcatcgacaccccgggtatcctgtcgggtgccaagcagagagtgagccgcggctacgacttcccggccgtgctgcgctggttcgcggagcgcgtggacctcatcatcctgctctttgatgcgcacaagctggagatctcggacgagttctcagaggccatcggcgcgttgcggggccatgaggacaagatccgcgtggtgctcaacaaggccgacatggtggagacgcagcagctgatgcgcgtctacggcgcgctcatgtgggcgctgggcaaggtggtgggcacgcccgaggtgctgcgcgtctacatcggctccttctggtcccagcccctcctcgtgcccgacaaccggcgcctcttcgagctggaggagcaggacctcttccgcgacatccagggcctgccccggcacgcagccttgcgcaagctcaacgacctggtgaagagggcccggctggtgcgagttcacgcttacatcatcagctacctgaagaaggagatgccctctgtgtttgggaaggagaacaagaagaagcagctgatcctcaaactgcccgtcatctttgcgaagattcagctggaacatcacatctcccctggggactttcctgattgccagaaaatgcaggagctgctgatggcgcacgacttcaccaagtttcactcgctgaagccgaagctgctagaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggtgaccaaggacaagtccaaatacgacgagatcttctacaacctggcgcctgccgacggcaagctgagcggctccaaggccaagacctggatggtggggaccaagctccccaactcagtgctggggcgcatctggaagctcagcgatgtggaccgcgacggcatgctggatgatgaggagttcgcgctggccagccacctcatcgaggccaagctggaaggccacgggctgcccgccaacctgccccgtcgcctggtgccaccctccaagcgacgccacaagggctccgccgagtgagccggcccccctcccatggccctgctgtggctccccagctccagtcggctgcacgcacacccctgctccggctcacacacgccctgcctgccctccctgcccagctgtaaggaccgggggtctccctcctcactaccgccagacaccccggtggaagcatttagaggggaccacgggagggacaaggcttctctgtccgcccttcacacctccagcctcacgttcacttaggcacatcacacacacactggcacacgcaggcatccatccatccgtcattcattcaaatatttattgagcacctactatgtgcccagccctgttctaggcactgggcattaccatagagaacaaaatagacaaatacatctgccctcatggaaggtgacgttcccaggagagggcacctacacagtcacgcaaacacacactaattcctggcagggcccccagcccctcccctggctgagcagccctgtggctgaaatgactagcagataaacagacccccttctgctccgcttcctcctgcccagccaggcaacaccctcaaccggctccatcacatcctcaggtctcgggaccatggggggctcagaggggagacacacctactgcttcctcagatgggcccctccgcagccccttcccttgctcggggaaagcccccaattctgcccacacccatttatttccttccttccttccttcttttctttccttccttccttcttttttgtttttgcccccaattctgcccatacccatttctttctttccttccttccttcttttttgtttttgcccccagttctgtccacaccccttccctttcctgtcctgtcctttctttcttttttgatagaatcttgctctgtcgcccaggctggagtgcagtggtgagatctcagctcactgcaacctccacctcctgggttgaagtgattctcgtgcctcagcctcctgagtagctgggactgcaggcacgcgccaccacgcccagctaatttttgtatttgagtagagacggggtttcaccatgttggccaggctggtctcgaactccgcatctcaggtgatctgctcgccttggcctcccaaagtgatgggattacaggcatgagccaccgtgcccggcttcacacccatttctttaaaaaggatcccgtagcaggcagaaaagccccttccatcctgctcctctgatactgtgcccccttggagatatttccgtcctccacccacgtgtctgtggctggaactgcccagcctgctcctggccccctggaagcctccccacagctggtaatctggacttaaggattgctgggccaccgcctctctgcctaccaccattccatatttaagtggagcccctacgtagaaaggccccggggctttattttagtctccttttcagggatgtcgtgggcgggggagggggttcttggtgctacagccctctccccacccctaaagggacgccgacgctgtttgctgccttcaccacatattagtgcttgaccctggcaggggaccccatggaaaagatggggaagagcaaaatacatggagacgacgcaccctccaggatgctcgctgggattcccacgcccaccactgtcccccaccccatggctgggaggggcctctgaacggaacagtgtccccacagagcgaataaagccaaggcttcttccc

SEQ ID NO: 9366 - DNA, 1639 bp, Homo sapiens
agacggctccggacgggaccgcgagcacaggccgctccgcgggcgcttcggatcctcgcgggaccccaccctctcccagcctgcccagcccgctgcagccgccagcgcgccccgtcggcagctctccatctgcacgtctctccgtgaaccccgtgagcggtgtgcagccaccatgttcagctggctgaagcggggcggggcacggggccagcagcccgaggccatccgcacggtgacctcggccctcaaggagctgtaccgcacgaagctgctgccgctggaggagcactaccgctttggggccttccactcgccggccctggaggacgcagacttcgacggcaagcccatggtgctggtggccggccagtacagcacgggcaagaccagcttcatccagtacctgctggagcaggaggtgcccggctcccgcgtggggcctgagcccaccaccgactgctttgtggccgtcatgcacggggacactgagggcaccgtgcccggcaacgccctcgtcgtggacccggacaagcccttccgcaaactcaaccctttcggaaacaccttcctcaacaggttcatgtgtgcccagctccctaatcaggtcctggagagcatcagcatcatcgacaccccgggtatcctgtcgggtgccaagcagagagtgagccgcggctacgacttcccggccgtgctgcgctggttcgcggagcgcgtggacctcatcatcctgctctttgatgcgcacaagctggagatctcggacgagttctcagaggccatcggcgcgttgcggggccatgaggacaagatccgcgtggtgctcaacaaggccgacatggtggagacgcagcagctgatgcgcgtctacggcgcgctcatgtgggcgctgggcaaggtggtgggcacgcccgaggtgctgcgcgtctacatcggctccttctggtcccagcccctcctcgtgcccgacaaccggcgcctcttcgagctggaggagcaggacctcttccgcgacatccagggcctgccccggcacgcagccttgcgcaagctcaacgacctggtgaagagggcccggctggtgcgagttcacgcttacatcatcagctacctgaagaaggagatgccctctgtgtttgggaaggagaacaagaagaagcagctgatcctcaaactgcccgtcatctttgcgaagattcagctggaacatcacatctcccctggggactttcctgattgccagaaaatgcaggagctgctgatggcgcacgacttcaccaagtttcactcgctgaagccgaagctgctagaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggaccaaggacaagtccaaatacgacgagatcttctacaacctggcgcctgccgacggcaagctgagcggctccaaggccaagacctggatggtggggaccaagctccccaactcagtgctggggcgcatctggaagctcagcgatgtggaccgcgacggcatgctggatga

SEQ ID NO: 9367 - DNA, 1766 bp, Homo sapiens
agacggctccggacgggaccgcgagcacaggccgctccgcgggcgcttcggatcctcgcgggaccccaccctctcccagcctgcccagcccgctgcagccgccagcgcgccccgtcggttcatgtgtgcccagctccctaatcaggtcctggagagcatcagcatcatcgacaccccgggtatcctgtcgggtgccaagcagagagtgagccgcggctacgacttcccggccgtgctgcgctggttcgcggagcgcgtggacctcatcatcctgctctttgatgcgcacaagctggagatctcggacgagttctcagaggccatcggcgcgttgcggggccatgaggacaagatccgcgtggtgctcaacaaggccgacatggtggagacgcagcagctgatgcgcgtctacggcgcgctcatgtgggcgctgggcaaggtggtgggcacgcccgaggtgctgcgcgtctacatcggctccttctggtcccagcccctcctcgtgcccgacaaccggcgcctcttcgagctggaggagcaggacctcttccgcgacatccagggcctgccccggcacgcagccttgcgcaagctcaacgacctggtgaagagggcccggctggtgcgagttcacgcttacatcatcagctacctgaagaaggagatgccctctgtgtttgggaaggagaacaagaagaagcagctgatcctcaaactgcccgtcatctttgcgaagattcagctggaacatcacatctcccctggggactttcctgattgccagaaaatgcaggagctgctgatggcgcacgacttcaccaagtttcactcgctgaagccgaagctgctagaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggtgaccaaggacaagtccaaatacgacgagatcttctacaacctggcgcctgccgacggcaagctgagcggctccaaggccaagacctggatggtggggaccaagctccccaactcagtgctggggcgcatctggaagctcagcgatgtggaccgcgacggcatgctggatgatgaggagttcgcgctggccagccacctcatcgaggccaagctggaaggccacgggctgcccgccaacctgccccgtcgcctggtgccaccctccaagcgacgccacaagggctccgccgagtgagccggcccccctcccatggccctgctgtggctccccagctccagtcggctgcacgcacacccctgctccggctcacacacgccctgcctgccctccctgcccagctgtaaggaccgggggtctccctcctcactaccgccagacaccccggtggaagcatttagaggggaccacgggagggacaaggcttctctgtccgcccttcacacctccagcctcacgttcacttaggcacatcacacacacactggcacacgcaggcatccatccatccgtcattcattcaaatatttattgagcacctactatgtgcccagccctgttctaggcactgggcattaccatagagaacaaaatagacaaatacatctgccctcatggaaggtgacgttcccaggagagggcacctacacagtcacgc

SEQ ID NO: 9368 - DNA, 2614 bp, Homo sapiens
agacggctccggacgggaccgcgagcacaggccgctccgcgggcgcttcggatcctcgcgggaccccaccctctcccagcctgcccagcccgctgcagccgccagcgcgccccgtcggcagctctccatctgcacgtctctccgtgaaccccgtgagcggtgtgcagccaccatgttcagctggctgaagcggggcggggcacggggccagcagcccgaggccatccgcacggtgacctcggccctcaaggagctgtaccgcacgaagctgctgccgctggaggagcactaccgctttggggccttccactcgccggccctggaggacgcagacttcgacggcaagcccatggtgctggtggccggccagtacagcacgggcaagaccagcttcatccagtacctgctggagcaggaggtgcccggctcccgcgtggggcctgagcccaccaccgactgctttgtggccgtcatgcacggggacactgagggcaccgtgcccggcaacgccctcgtcgtggacccggacaagcccttccgcaaactcaaccctttcggaaacaccttcctcaacaggttcatgtgtgcccagctccctaatcaggtcctggagagcatcagcatcatcgacaccccgggtatcctgtcgggtgccaagcagagagtgagccgcggctacgacttcccggccgtgctgcgctggttcgcggagcgcgtggacctcatcatcctgctctttgatgcgcacaagctggagatctcggacgagttctcagaggccatcggcgcgttgcggggccatgaggacaagatccgcgtggtgctcaacaaggccgacatggtggagacgcagcagctgatgcgcgtctacggcgcgctcatgtgggcgctgggcaaggtggtgggcacgcccgaggtgctgcgcgtctacatcggctccttctggtcccagcccctcctcgtgcccgacaaccggcgcctcttcgagctggaggagcaggacctcttccgcgacatccagggcctgccccggcacgcagccttgcgcaagctcaacgacctggtgaagagggcccggctggtgcgagttcacgcttacatcatcagctacctgaagaaggagatgccctctgtgtttgggaaggagaacaagaagaagcagctgatcctcaaactgcccgtcatctttgcgaagattcagctggaacatcacatctcccctggggactttcctgattgccagaaaatgcaggagctgctgatggcgcacgacttcaccaagtttcactcgctgaagccgaagctgctagaggcactggacgagatgctgacgcacgacatcgccaagctcatgcccctgctgcggcaggaggagctggagagcagccctgtggctgaaatgactagcagataaacagacccccttctgctccgcttcctcctgcccagccaggcaacaccctcaaccggctccatcacatcctcaggtctcgggaccatggggggctcagaggggagacacacctactgcttcctcagatgggcccctccgcagccccttcccttgctcggggaaagcccccaattctgcccacacccatttatttccttccttccttccttcttttctttccttccttccttcttttttgtttttgcccccaattctgcccatacccatttctttctttccttccttccttcttttttgtttttgcccccagttctgtccacaccccttccctttcctgtcctgtcctttctttcttttttgatagaatcttgctctgtcgcccaggctggagtgcagtggtgagatctcagctcactgcaacctccacctcctgggttgaagtgattctcgtgcctcagcctcctgagtagctgggactgcaggcacgcgccaccacgcccagctaatttttgtatttgagtagagacggggtttcaccatgttggccaggctggtctcgaactccgcatctcaggtgatctgctcgccttggcctcccaaagtgatgggattacaggcatgagccaccgtgcccggcttcacacccatttctttaaaaaggatcccgtagcaggcagaaaagccccttccatcctgctcctctgatactgtgcccccttggagatatttccgtcctccacccacgtgtctgtggctggaactgcccagcctgctcctggccccctggaagcctccccacagctggtaatctggacttaaggattgctgggccaccgcctctctgcctaccaccattccatatttaagtggagcccctacgtagaaaggccccggggctttattttagtctccttttcagggatgtcgtgggcgggggagggggttcttggtgctacagccctctccccacccctaaagggacgccgacgctgtttgctgccttcaccacatattagtgcttgaccctggcaggggaccccatggaaaagatggggaagagcaaaatacatggagacgacgcaccctccaggatgctcgctgggattcccacgcccaccactgtcccccaccccatggctgggaggggcctctgaacggaacagtgtccccacagagcgaataaagccaaggcttcttccc

SEQ ID NO: 9369 - DNA, 1919 bp, Homo sapiens
agacggctccggacgggaccgcgagcacaggccgctccgcgggcgcttcggatcctcgcgggaccccaccctctcccagcctgcccagcccgctgcagccgccagcgcgccccgtcggcagctctccatctgcacgtctctccgtgaaccccgtgagcggtgtgcagccaccatgttcagctggctgaagcggggcggggcacggggccagcagcccgaggccatccgcacggtgacctcggccctcaaggagctgtaccgcacgaagctgctgccgctggaggagcactaccgctttggggccttccactcgccggccctggaggacgcagacttcgacggcaagcccatggtgctggtggccggccagtacagcacgggcaagaccagcttcatccagtacctgctggagcaggaggtgcccggctcccgcgtggccgtcatgcacggggacactgagggcaccgtgcccggcaacgccctcgtcgtggacccggacaagcccttccgcaaactcaaccctttcggaaacaccttcctcaacaggttcatgtgtgcccagctccctaatcaggtcctggagagcatcagcatcatcgacaccccgggtatcctgtcgggtgccaagcagagagtgagccgcggctacgacttcccggccgtgctgcgctggttcgcggagcgcgtggacctcatcatcctgctctttgatgcgcacaagctggagatctcggacgagttctcagaggccatcggcgcgttgcggggccatgaggacaagatccgcgtggtgctcaacaaggccgacatggtggagacgcagcagctgatgcgcgtctacggcgcgctcatgtgggcgctgggcaaggtggtgggcacgcccgaggtgctgcgcgtctacatcggctccttctggtcccagcccctcctcgtgcccgacaaccggcgcctcttcgagctggaggagcaggacctcttccgcgacatccagggcctgccccggcacgcagccttgcgcaagctcaacgacctggtgaagagggcccggctggtgcgagttcacgcttacatcatcagctacctgaagaaggagatgccctctgtgtttgggaaggagaacaagaagaagcagctgatcctcaaactgcccgtcatctttgcgaagattcagctggaacatcacatctcccctggggactttcctgattgccagaaaatgcaggagctgctgatggcgcacgacttcaccaagtttcactcgctgaagccgaagctgctagaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggtgaccaaggacaagtccaaatacgacgagatcttctacaacctggcgcctgccgacggcaagctgagcggctccaaggccaagacctggatggtggggaccaagctccccaactcagtgctggggcgcatctggaagctcagcgatgtggaccgcgacggcatgctggatgatgaggagttcgcgctggccagccacctcatcgaggccaagctggaaggccacgggctgcccgccaacctgccccgtcgcctggtgccaccctccaagcgacgccacaagggctccgccgagtgagccggcccccctcccatggccctgctgtggctccccagctccagtcggctgcacgcacacccctgctccggctcacacacgccctgcctgccctccctgcccagctgtaaggaccgggggtctccctcctcactaccgccagaca

SEQ ID NO: 9370 - DNA, 1215 bp, Homo sapiens
gaggccaagaaggttctagggggtggaggagcctgaggtgttggtttaaggagcagcgagagtgggttcacgcttacatcatcagctacctgaagaaggagatgccctctgtgtttgggaaggagaacaagaagaagcagctgatcctcaaactgcccgtcatctttgcgaagattcagctggaacatcacatctcccctggggactttcctgattgccagaaaatgcaggagctgctgatggcgcacgacttcaccaagtttcactcgctgaagccgaagctgctagaggcactggacgagatgctgacgcacgacatcgccaagctcatgcccctgctgcggcaggaggagctggagagcaccgaggtgggcgtgcaggggggcgcttttgagggcacccacatgggcccgtttgtggagcggggacctgacgaggccatggaggacggcgaggagggctcggacgacgaggccgagtgggtggtgaccaaggacaagtccaaatacgacgagatcttctacaacctggcgcctgccgacggcaagctgagcggctccaaggccaagacctggatggtggggaccaagctccccaactcagtgctggggcgcatctggaagctcagcgatgtggaccgcgacggcatgctggatgatgaggagttcgcgctggccagccacctcatcgaggccaagctggaaggccacgggctgcccgccaacctgccccgtcgcctggtgccaccctccaagcgacgccacaagggctccgccgagtgagccggcccccctcccatggccctgctgtggctccccagctccagtcggctgcacgcacacccctgctccggctcacacacgccctgcctgccctccctgcccagctgtaaggaccgggggtctccctcctcactaccgccagacaccccggtggaagcatttagaggggaccacgggagggacaaggcttctctgtccgcccttcacacctccagcctcacgttcacttaggcacatcacacacacactggcacacgcaggcatccatccatccgtcattcattcaaatatttattgagcacctactatgtgcccagccctgttctaggcactgggcattaccatagagaacaaaatagacaaatacatctgccctcatggaaggtgacgttcccaggagagggcacctacacagtcacgcaaacacacacta

SEQ ID NO: 9371 - DNA, 4636 bp, Homo sapiens
aactttaattgccaagatttcacccctcctcctcaagcccagattatttatcctccctccggcctgggctgctggatgcagcagcggctgggcttggtcccaggagcagggagagtgcgctcccggccctcctagccgcgtgcccgggccatggtgcggctgagccccgcgcttgggtgaggcggcggcgcggctcggagcccggcggaccggtcctacgggacatcttcccctgaggaggagtcttcccctggggctgcgtgccgggggcgagcggcggccgcgatgttcagctggctgggtacggacgaccgccggaggaaggaccccgaggttttccagacggtgagtgaggggctcaagaaactctacaagagcaagctgctgcccttggaagagcattaccgcttccacgagttccactcgcccgccctggaggatgccgacttcgacaacaagcccatggttctgctggtgggccagtactccactgggaagaccaccttcatcaggtacctgctggaacaggacttcccaggcatgaggattgggcctgagcccaccacagactccttcattgcggtgatgcagggagacatggaggggatcatccctgggaacgccctggtggtggatcccaagaaacccttcaggaaactcaacgcctttggcaacgccttcttgaacaggttcgtgtgtgcccagctacctaaccctgtgctggagagcatcagcgtcatcgacacaccagggatcctctctggggagaagcagaggatcagccgggggtatgactttgcagctgtccttgagtggtttgccgagcgggttgaccgcatcattctgctcttcgatgcccacaaactggacatctctgatgagttctcagaagtcatcaaagccctcaagaaccacgaggacaagatgcgagtggtgctgaacaaagctgaccagatcgagacgcagcagctgatgcgggtgtacggggccctcatgtggtccttggggaagatcgtgaacaccccagaggtgatccgggtctacatcggctccttctggtcccaccccctcctcatccctgacaaccggaagctctttgaggctgaggaacaggacctattcagggacatccagagtctgccccgaaatgctgccctgcgcaagctcaacgacctcatcaaaagggccaggctggccaaggtccacgcctacatcatcagctctctgaagaaggagatgccctcggtgttcgggaaggacaacaagaagaaggagctggtcaacaacctggccgagatctatggccggatcgagcgggagcaccagatctcacctggggacttccccaatctgaagaggatgcaggaccagctgcaggcccaggactttagcaagttccagccgctgaagagcaagctgctggaggtagtggacgacatgctggcccatgacattgcccagctcatggtgctagtgcgccaggaggagtcacagcggcccatccagatggtgaagggcggagcgttcgagggcaccctgcacggcccctttgggcatggctatggggagggggctggagaaggtatcgatgatgctgagtgggtggtggccagggacaagcccatgtacgacgagatcttctacaccctgtcaccggtggatggcaagatcacaggcgctaatgccaagaaggagatggtgcgctccaagctgcccaacagtgtgctgggcaagatctggaagctggccgacattgacaaggatggcatgctggacgacgacgagtttgcactggccaaccacctcatcaaagtcaagctggaggggcacgagctgcccaacgagctgcctgcccacctcctgcccccgtccaagaggaaagttgccgagtgatggggtggggggacattcagacgggcagtgttagaggaggagatgggagcggtgactacacacacacacacacacacacacacacacacaaacatgcacacacacatatgcatatcttgacattgctctgtaggtgagagaggaccatgacgcccatgtttgcagctgatacttgtttgggcacacctccaagttctcgggattagaaggacaagagcactcccaggccccagagtctaagcctaagtctctatcgctcttcccctctcctcggccactccccagataccagacctgaggcaattcacttgccagcacagatggccaacccacctccagattccccagtgcttccacacccgggctctgagcaaatggaaaagacttttcatttagtagacaattcacttctttttctgtgcttcccctatctgctttggcttcctaataagaaatccattcaagagctaggagatctgagggcaggcgggcagctgcagggaggagaggtgagaaaggaagcgtcttctagagacattggcccaggagctctgttctttcctaatctaagcctctgtcttcttcggcaaaccttgctttgaactctgccagtatttcattttaaagaatcccagagcgggagagagaagagaaaaaaattgataagagtgaggaaattgtcctgtagtctattgaaaaccagtcaaggtggttttagttcatagattttgttagatgttctttccacctggcctatgatgtttagatgttcatacttgactcacatttacccagcccctcctgcgtaccaggagctgtgttaggcactttatatacattattctatgtggccctcactgatgccccagggaagtatgcattagccttcccattttgcagttgaggaggctgagtagcctcagaagggtttaggcgaccttctgaaactcacagaagtcacgtgatggagagaggattcaaagccagggcctcagaccctcacacacttgtctgtgctatgatgtatgcaggatcccagcattgatacccaatgacaaactatggagaacaagcaaagtatgcaggccccctgcagcctcccaggacaggctggcaagggaggagggccggccagcatttggtggcccatcagtctggccatctgtcacgtcacagaagcaaaccgtgccttctggctctgcgccccatattcccagcatcatagacatccaacagcaccagcaggagagtgggctagcctgctggatgctgttcgtgcctgtccctgctctgcctcccacccagttgcctgaatcatcccagctcagatgcagccactgtctcttgtcaagtgggacctcatactattctcagaaggctaacttgagaggtttggggccttgttccccagagggtccccagggactctgcagtgtccttggcaaatccccactgtactcaatgccctacattctcttctgtggtctctcccctggcttgcttcatggccactgaaccaatcactttgtatgctatgctcctactgtgatggaaaacaaaatgagtataacttattttatatccatattcagactatatagagaatattctatgcatctatgacgtgcttactactgcagtgcatttgtcattagtcttcatgttaatacagtacatttattctttggtacctgcctggccacagagcatcattcaatggaggctgagggagaagggctgggttcttacttggagttcctggtgaaatctttggctggaaagggctcactggggccacccaatggccagcatccacaaccagcttcccagtgggctggagtttgtctaggctcagtgaccaacccaggcacagctggtggagccaccgctccctgctcctctggagtgaagatgttccctaagcccctgggcttccttctgcaaatacacatttctctttcacatgaaatgaagggcagacaaaggccaggcaaagaggtctcacctgctctggagaaaacccttgagtgccgagtgcaggttagggaccatttctcaactccacacctttcttcaagctgaaggagaaatgggaaggaaatagcagaggtaggtgaagttcctgtctttttattttataggaaagggagatgtctgttatcccctttcttcactgccactggacacacatgccactttcctgcccttctacatatgctgcctctcttccctctctccatcttgaagtctccacccaggagagacctgtgaggtgtgggaattccatgtttgcacagctcccatctccctggaaagaggaactgatgtttgaggggacagatgtgggtcactttccctggcagtgccctctagccttgctgccttggctttctgaccccttccaggcttcaggggcctgggagatctcatgcctcagcccaggaaacatttaatagggaaagcagagacatgtcatgtcagccccacagacaagaatttctagagcacttgtcctgttgttccttgccccgacattactcagtctgggccatggaatccatccaataaacacagcaacaccctatgctactgaccaagcaaagcttgcccctggtaccaaagagctaaatcatgaccaaagtgtgacatgaatgtaactgaaatgcgggttagttgctcaatgtatgcaaagtcccacggacaagagtaaagtctgataccaataaagtgaatgtattccaaa

SEQ ID NO: 9372 - DNA, 3328 bp, Homo sapiens
aaacatggcggcgccctgcgcggcttcccgtcgccgcaaccgtggggccggccctgccttgccagtactaggggacttcctctgcgcgccggcttcctgcccagctggcatttaaaccaccgcctggggctgcaggatgctgctgcggatgcagagctgtccgcgggctgggcagcgtcgccgtctcccctgagccgcctcggtccggcaggagcggagccgaagcatcccttgctgcacgcagggcagagcaggcgagggctgggggccgatcggggaccccggcttgggaccccggcatctggcagtttccttgcaggttcaactttaattgccaagatttcacccctcctcctcaagcccagattatttatcctccctccggcctgggctgctggatgcagcagcggctgggcttggtcccaggagcagggagagtgcgctcccggccctcctagccgcgtgcccgggccatggtgcggctgagccccgcgcttgggtgaggcggcggcgcggctcggagcccggcggaccggtcctacgggacatcttcccctgaggaggagtcttcccctggggctgcgtgccgggggcgagcggcggccgcgatgttcagctggctgggtacggacgaccgccggaggaaggaccccgaggttttccagacggtgagtgaggggctcaagaaactctacaagagcaagctgctgcccttggaagagcattaccgcttccacgagttccactcgcccgccctggaggatgccgacttcgacaacaagcccatggttctgctggtgggccagtactccactgggaagaccaccttcatcaggtacctgctggaacaggacttcccaggcatgaggattgggcctgagcccaccacagactccttcattgcggtgatgcagggagacatggaggggatcatccctgggaacgccctggtggtggatcccaagaaacccttcaggaaactcaacgcctttggcaacgccttcttgaacaggttcgtgtgtgcccagctacctaaccctgtgctggagagcatcagcgtcatcgacacaccagggatcctctctggggagaagcagaggatcagccggggaccagctgcaggcccaggactttagcaagttccagccgctgaagagcaagctgctggaggtagtggacgacatgctggcccatgacattgcccagctcatggtgctagtgcgccaggaggagtcacagcggcccatccagatggtgaagggcggagcgttcgagggcaccctgcacggcccctttgggcatggctatggggagggggctggagaaggtatcgatgatgctgagtgggtggtggccagggacaagcccatgtacgacgagatcttctacaccctgtcaccggtggatggcaagatcacaggcgctaatgccaagaaggagatggtgcgctccaagctgcccaacagtgtgctgggcaagatctggaagctggccgacattgacaaggatggcatgctggacgacgacgagtttgcactggccaaccacctcatcaaagtcaagctggaggggcacgagctgcccaacgagctgcctgcccacctcctgcccccgtccaagaggaaagttgccgagtgatggggtggggggacattcagacgggcagtgttagaggaggagatgggagcggtgactacacacacacacacacacacacacacacacacaaacatgcacacacacatatgcatatcttgacattgctctgtaggtgagagaggaccatgacgcccatgtttgcagctgatacttgtttgggcacacctccaagttctcgggattagaaggacaagagcactcccaggccccagagtctaagcctaagtctctatcgctcttcccctctcctcggccactccccagataccagacctgaggcaattcacttgccagcacagatggccaacccacctccagattccccagtgcttccacacccgggctctgagcaaatggaaaagacttttcatttagtagacaattcacttctttttctgtgcttcccctatctgctttggcttcctaataagaaatccattcaagagctaggagatctgagggcaggcgggcagctgcagggaggagaggtgagaaaggaagcgtcttctagagacattggcccaggagctctgttctttcctaatctaagcctctgtcttcttcggcaaaccttgctttgaactctgccagtatttcattttaaagaatcccagagcgggagagagaagagaaaaaaattgataagagtgaggaaattgtcctgtagtctattgaaaaccagtcaaggtggttttagttcatagattttgttagatgttctttccacctggcctatgatgtttagatgttcatacttgactcacatttacccagcccctcctgcgtaccaggagctgtgttaggcactttatatacattattctatgtggccctcactgatgccccagggaagtatgcattagccttcccattttgcagttgaggaggctgagtagcctcagaagggtttaggcgaccttctgaaactcacagaagtcacgtgatggagagaggattcaaagccagggcctcagaccctcacacacttgtctgtgctatgatgtatgcaggatcccagcattgatacccaatgacaaactatggagaacaagcaaagtatgcaggccccctgcagcctcccaggacaggctggcaagggaggagggccggccagcatttggtggcccatcagtctggccatctgtcacgtcacagaagcaaaccgtgccttctggctctgcgccccatattcccagcatcatagacatccaacagcaccagcaggagagtgggctagcctgctggatgctgttcgtgcctgtccctgctctgcctcccacccagttgcctgaatcatcccagctcagatgcagccactgtctcttgtcaagtgggacctcatactattctcagaaggctaacttgagaggtttggggccttgttccccagagggtccccagggactctgcagtgtccttggcaaatccccactgtactcaatgccctacattctcttctgtggtctctcccctggcttgcttcatggccactgaaccaatcactttgtatgctatgctcctactgtgatggaaaacaaaatgagtataacttattttatatccatattcagactatatagagaatattctatgcatctatgacgtgcttactactgcagtgcatttgtcattagtcttcatgttaatacagtacatttattctttggta

SEQ ID NO: 9373 - DNA, 3983 bp, Homo sapiens
ccagcgcggccggggcggctcagtgcgagccggggagagtcgaacccggagcagggtcccatccgagcgtggactggcggcaggatgttcagctggatggggcggcaggcgggcgggcgcgaacgcgctggcggcgcggacgcggtgcagacggtgacgggcgggctgcgctcgctctacctgcgcaaggtgctgccgctggaggaggcgtaccgcttccacgagttccactcgcctgcgctggaggacgccgacttcgagaacaagcccatgatcctgctggtgggccagtacagcaccggcaagaccaccttcatcagatacctactggagcaggatttcccaggcatgaggattggtccggagcccaccacagactccttcatcgccgtgatgtatggagagactgagggcagcaccccagggaatgctttagtcgtggaccccaaaaagccgtttagaaagctcagtcgctttggaaacgctttcctgaatcgattcatgtgctcacagctccccaatcaggtcctgaagagcatcagcgtcatcgacagccccggcatcctttctggggagaagcagcgcatcagccgaggctatgacttctgccaggtcctgcagtggtttgccgagagggtggacaggatcatcctgctctttgacgctcacaagctggacatctcagatgaattctcagaggccatcaaggccttccggggccaggacgacaagatccgtgtcgtgctgaacaaggccgaccaagtggacacgcagcagctgatgcgggtctacggggccctcatgtggtccctaggcaaggtcatcaacacgcccgaggtactgcgcgtctacattggctccttctgggcgcagcccctgcagaacacggacaaccgccggctcttcgaggctgaggcccaggacctctttagagacatccagagcctcccccagaaggcagcggtgcgcaagctcaacgacctcatcaagcgagcgaggctggccaaggtgcatgcctacatcatcagctacctgaagaaggagatgccaagtgtatttggaaaggaaaacaagaagagagagcttatcagcaggctaccggaaatctacattcagctacagcgagaataccagatttctgcaggggacttccctgaggtcaaggctatgcaggaacagcttgagaactatgacttcaccaaattccactcgctgaagcccaagctgatcgaggcagtggacaacatgctgagcaacaagatctcgcccctcatgaacctcatcagccaggaggagacgagcacgcccacgcagctggtgcagggcggcgccttcgatggcaccaccgagggccccttcaaccagggctacggggagggtgccaaggagggcgccgacgaggaggagtgggtcgtggccaaagacaagcccgtctacgacgagctcttctacactctgtcgcccatcaatggcaagatatcaggtgtcaacgccaagaaggagatggtgacctccaagctgcccaacagcgtcctgggcaagatctggaagctggccgactgcgactgcgacggcatgcttgatgaggaggagttcgcgctggccaagcacctcatcaagatcaagctcgacggctacgagctgcccagcagcctgcccccccacctcgtgcccccctcgcacaggaagtccctgcccaaggccgactgaggggtgggctgcagaacggggtgggaactgggggacctgggcctcaggcctgctccaccactgactcaccgaatgaccttgggcaaggcactgccctctctgtgccttggtttccccatctgtagaatggggagggtggacactggaaactagatgacttctttcacctccaaaattcccttagtttctatgaaaatattgggggtaggggggtggattaggagattgaagggttgagaagaaagagaaattgtccaaagagtcctcagaacctgcctggagaaatgcgcatgggggtgggcctggtaagtcccaggaaccacaggaagtgagctaaggctcacccagagcagctgggtctccaggctgcctgggctttttgtcctcatgaacaactctggagcagctgtctgtccctcagagggcacctggaggcagcaaagattatcttatttattttattttgttttctgctatatttagagtggcaaaaaaatagagcagagggtttctgctgtctccagactgtctaccaaagagaaggcgacagatgcctcctgggtttggaagggggatgcactgtggatctgccatccattctgcagtctccagcagagcaggcagtcaggccccagcgtgcctccatcccagtgccccgatgaccatctggtcagccctcccaacctcccttccagggggcttaccagcaaagccatattcggctaggaatttggaattcacaacctttattaacccctggcaaaacttcccgtttgcatgtcaaatcacattgaagcctgaaaattagcttttcttactggtttttccaataagtaatagcaaagcccacttatcatacttaaactacagtaaagaaaagaggtggttctctgcagtgatcgtttagtgtggccctcaaacattaaatatcccgaggtctccttggtgggtggcaggatttaaattcaatcaaatcctgtcctagtgtgtgcagtgtcttcggccctgtggacacaggtgaatgagggaccagccctgccctgggctgttgagaagagatcagtccacccagagttagacattgtttttgtagaaaacaggcatttattatgtctagggttttgtgttttttttttttccttacaggataaaagcctttatacagaaacaaaatggaacctttcatataaaaccttttctttaaaggctgtgtggttcgtatcatgaatgcccatcacgaggcaggattcgggcacatacctgtacttctgctccagagtgtgcgctccccaaatcccctgagtaaacctctctggactgctgctcagacacctgcgtcaggtggaggtgcctccccctctgtgggcaccagcttggggaggtaggtgacttttccttgcaaatctccctgcctcatctccagaaaattgcatacctgcatggcctctctgcattatttatgcaggaagagacacgaaacagcaatggccacatggtatgggggcctgctggcaccagaagtgaatgaaatcagaaccgtcccactgagtcttccaaaaggcacataattttttttttctgtcacctgcctttggtgacagggtcaaaggcacagattgaagagaaaatcttgatttgggagaagcatttatatccagatgcctacccttacactccctagcttactttctacataatttagttttaagagcaggaaatgcataacatggtttttagtcttaacaagcacttaaattcattagacgcatagaaaagaaccatttattattttattatttttatttttattttgagaggaagtctctgtcacccaggctggagtgcagtggcgcaatctcagttcactgcaacctccgcctcccaggttcaagtgattcccctgcctcagcctcccaagtagctgggactacaggcacccgccaccacgcccggctaatttttgtattttagtagagatggggttttaccatgttggtcaatatggtctcgatctcctgacctcgtgatctacccacctcggcctcccaaagtgctgtaacctaagcagacagttctgtgaatgcgtgaggaccacctgaagtctgcagccacggtggaggtcaccaaagggtgaactgagagagaagagggaattcacttgcccaaaggtttacagatgcccaggcaaactgatttttccatccagaattatcttgttctttaactctcctcaattgtcatatataaacatgaatttatatacatgtgtgtca

SEQ ID NO: 9374 - DNA, 2235 bp, Homo sapiens
ggcgcacttccgcccgggcgcattgtagccccgcggacagctgggccagggtgcgggcctgcgcctccctcggctcctggcgcgggcctcggggagaggggtggaagatgtctatggatgtgacattcctggggacgggtgcagcatacccatctccaacccggggtgcctctgctgtggtccttcggtgtgaaggcgagtgctggctctttgactgtggggagggaacacagacacagcttatgaaaagccaacttaaagcagggagaattaccaagatcttcatcacacaccttcatggagaccatttctttggccttcctgggctcctctgcacaatcagcctgcagagtggctccatggtgtccaaacagcctattgaaatctatggccctgtagggcttcgggactttatctggcgaaccatggaactctctcacacggagctggtcttccattatgtggttcatgaactggttcctacagcagatcaatgtcctgcagaagaactaaaagaatttgcgcatgtgaatagagcagacagtcctcccaaagaggaacaaggaagaactatcctgttagactcagaagaaaactcataccttctgtttgatgatgaacaatttgttgtaaaagcatttcgcctctttcacagaattccctcatttgggttttcagtcgtggaaaagaaacgcccaggtaaactcaatgcacagaaacttaaagaccttggtgttccaccaggtcctgcctatgggaagctgaaaaatggaatttctgttgttctggaaaatggggttacaatttctccccaagatgtcttaaaaaagcctattgttggaagaaaaatctgcatattgggtgactgctctggggttgtgggtgatggaggagtaaaactgtgctttgaagcagacctgttgatccacgaagcaaccctggatgatgcccagatggacaaagcaaaggagcatggccacagcacaccacagatggcagcaacatttgcaaagttgtgccgtgcaaagaggctggttctgactcacttcagtcagaggtacaaaccagttgccttggccagagaaggagaaacagatggcattgcagaactaaaaaagcaagctgaatcagtgttagatctccaagaagtgactctagcagaagattttatggtgataagcattccaatcaagaaatgaaaccagtgttcctgagtgcacactgacatgtctgtgaatatgttactgaacctatagtccagtttttttatttcttgttttagtctgaaattatttgggccctaataatcctaaaaagaatggagctgcattgatgaattggctcagtatttaaagggagcaaactttttgataataaatctttttaagagaaaaaaaacccagcatcctttttgaagtccagatttgtcaaaatgatagactattcagttatacatcttattttgtgctactaccacagatagccaatattccatgcagtcctgggcttagcttctgcccagctttattgctgctattggcaaagagcacaggactcagccctcgtggctaaaaatggtattttggcagtttgtattgaatctgtttgtgttattaacagaagagggagaaatgtcatgagacgttggacaggcaggattgatgatagcatgaccatagctttgctggaatactgaatgcagggtttggctaggtgtttattttaacattttattaaactttctatttgggtcttaacccatggttctcagctggggtgacactgctcctctagaagcaggtttgaaattatgggtatgttttcttgtcacagtgactgagtacggtggtggtagtggtggtactactactactggtatttagtcagcagggataagggatgttagctgtcctgcaaagttttggtcagtcatatacaataaagaatcatctcaccccgaaatgcaaattgcaggcccattgagatacacagcaagttagtttatactcttgatgtgaatatagtttaccaaaattagtgacataatgagtggaattactaggtaagtcaaatcctaaagagtgaatgtgttagaattgcagtgtcataccaaataacattcaaaagaaatgagccattaagtgaagcttatgaacctggaggtaaaaaatgcttatctgttaaactgaggtttcattgacgtgtccctattaataaacgttatttgccccacaa

SEQ ID NO: 9375 - DNA, 2982 bp, Homo sapiens
agcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgaacagaggaggggaaagcaccaaccatggcagagtccagaaaggcctctcagcaggctcagtccagagcgatcttcagactccgagtcgaatgaaaatgagccacaccttccacatggtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacatttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttgggctcccacataagcactagtctatagatgcctcttaggactggtgcctggcacagccgcgggccaggaggctgccacacggaagcaagcagatgaactaatttcatttcaaggcagtttttaaagaagtcttggaaacagacggcggcacctttcctctaatccagcaaagtgattccctgcacaccagagacaagcagagtaacaggatcagtgggtctaagtgtccgagacttaacgaaaatagtatttcagctgcaataaagattgagtttgcaa

SEQ ID NO: 9376 - DNA, 2923 bp, Homo sapiens
agcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgaacagaggaggggaaagcaccaaccatggcagagtccagaaaggcctctcagcaggctcagtccagagcgatcttcagactccgagtcgaatgaaaatgagccacaccttccacatggtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacatttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttgggctcccacataagcactagtctatagatgcctcttaggactggtgcctggcacagccgcgggccaggaggctgccacacggaagcaagcagatgaactaatttcatttcaaggcagtttttaaagaagtcttggaaacagacggcggcacctttcctctaatccagcaaagtgattccctgcacaccagagacaagcagagtaacaggatcagtgggtctaagtgtccgagacttaacgaaaatagtatttcagctgcaataaagattgagtttgc

SEQ ID NO: 9377 - DNA, 3683 bp, Homo sapiens
agctcggtgcacggcgcgctgattggctggatccgccatgcggagcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgcggaccgtcggggtgctccggcggcccaaacaccgtgtacctgcaggtggtggcagcgggtagccgggactcgggcgccgcgctctacgtcttctccgagttcaaccggtatctcttcaactgtggagaaggcgttcagagactcatgcaggagcacaagttaaaggttgctcgcctggacaacatattcctgacacgaatgcactggtctaatgttgggggcttaagtggaatgattcttactttaaaggaaaccgggcttccaaagtgtgtactttctggacctccacaactggaaaaatacctcgaagcaatcaaaatattttctggtccattgaaaggaatagaactggctgtgcggccccactctgccccagaatacgaggatgaaaccatgacagtttaccagatccccatacacagtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacatttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcaccacatcagtatgattcctgccaaatgccttcaggaaggggctgagatctccagtcctgcagtggaaagattgatcagttcgctgttgcgaacatgtgatttggaagagtttcagacctgtctggtgcggcactgcaagcatgcgtttggctgtgcgctggtgcacacctctggctggaaagtggtctattccggggacaccatgccctgcgaggctctggtccggatggggaaagatgccaccctcctgatacatgaagccaccctggaagatggtttggaagaggaagcagtggaaaagacacacagcacaacgtcccaagccatcagcgtggggatgcggatgaacgcggagttcattatgctgaaccacttcagccagcgctatgccaaggtccccctcttcagccccaacttcagcgagaaagtgggagttgcctttgaccacatgaaggtctgctttggagactttccaacaatgcccaagctgattcccccactgaaagccctgtttgctggcgacatcgaggagatggaggagcgcagggagaagcgggagctgcggcaggtgcgggcggccctcctgtccagggagctggcaggcggcctggaggatggggagcctcagcagaagcgggcccacacagaggagccacaggccaagaaggtcagagcccagtgaagatctgggagaccctgaactcagaaggctgtgtgtcttctgccccacgcacgcacccgtatctgccctccttgctggtagaagctgaagagcacggtcccccaggaggcagctcaggataggtggtatggagctgtgccgaggcttgggctcccacataagcactagtctatagatgcctcttaggactggtgcctggcacagccgcgggccaggaggctgccacacggaagcaagcagatgaactaatttcatttcaaggcagtttttaaagaagtcttggaaacagacggcggcacctttcctctaatccagcaaagtgattccctgcacaccagagacaagcagagtaacaggatcagtgggtctaagtgtccgagacttaacgaaaatagtatttcagctgcaataaagattgagtttgcaattgtgagttcttttgcttcctcctgctgctgctacagagcagggtctgctgtgcaccaccttggagaaggctctctgtgctgtagtgtggcagctgcctggtacccgggtggcttggaagaagtcagctcccgtcgtagtgagcacctctggaacctgtcctcagagagccacccttattcgccaagtctttttgacaactcgagctgtgccagctcacagcagggcgtgctttctctatcaatcaatcaatcaatcaatcaaatcaatcagtgagagcctggctgggctggtgtcattggtcagggaaatgcaagtcttctggtggttctgggtaaaagtggagacaatagatttgctgtgttgttgcttccatactgagaggagtgaggatcactttgccctcgaaggttttgagaaatggcacacggggctggtttccattgtcctccttgcgggatttacagacgtggattagtgctcgacaaatggagagcattttccaaggaagtaagtaagtaaagtaagtaagtaagtaagtaagttgaatctagtatttattgtgtatattccctacccaggagaatgtaaaaagaagagctttaaaaactcaaaagacaagcaagcgagagatcagccagggacctggctttacacaggtggtgaccttcaggctccatcccggtgtgcatttgagattgacggccatgtccccgcaggtttattaaagcaagaacagatgccaagctcagggataataaatctattttaataacgtt

SEQ ID NO: 9378 - DNA, 858 bp, Homo sapiens
tccacatggtgttagccagagaagaggggtcagggactcttccctggtcgtagctttcatctgtaagcttcacttaaagagaggaaacttcttggtgctcaaagcaaaggagatgggcctcccagttgggacagctgccatcgctcccatcattgctgctgtcaaggacgggaaaagcatcactcatgaaggaagagaggttttgcagattttggctgaagagctgtgtactcctccagatcctggtgctgcttttgtggtggtagaatgtccagatgaaagcttcattcaacccatctgtgagaatgccacctttcagaggtaccaaggaaaggcagatgcccccgtggccttggtggttcacatggccccagcatctgtgcttgtggacagcaggtaccagcagtggatggagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataag

SEQ ID NO: 9379 - DNA, 835 bp, Homo sapiens
attttggctgaagagctgtgtactcctccagatcctggtgctgcttttgtggtggtagaatgtccagatgaaagcttcattcaacccatctgtgagaatgccacctttcagaggtttgggcctgacacccagcacttggtcctgaatgagaactgtgcctcagttcacaaccttcgcagccacaagattcaaacccagctcaacctcatccacccggacatcttccccctgctcaccagtttccgctgtaagaaggagggccccaccctcagtgtgcccatggttcagggtgaatgcctcctcaagtaccagctccgtcccaggagggagtggcagagggatgccattattacttgcaatcctgaggaattcatagttgaggcgctgcagcttcccaacttccagcagagcgtgcaggagtacaggaggagtgcgcaggacggcccagccccagcagagaaaagaagtcagtacccagaaatcatcttccttggaacagggtctgccatcccgatgaagattcgaaatgtcagtgccacacttgtcaacataagccccgacacgtctctgctactggactgtggtgagggcacatttgggcagctgtgccgtcattacggagaccaggtggacagggtcctgggcaccctggctgctgtgtttgtgtcccacctgcacgcagatcaccacacgggcttgccaagtatcttgctgcagagagaacgcgccttggcatctttgggaaagccgcttcaccctttgctggtggttgcccccaaccagctcaaagcctggctccagcagtaccacaaccagtgccaggaggtcctgcacc

SEQ ID NO: 9380 - DNA, 1023 bp, Homo sapiens
tgaccgtgagcctgggtgaaagggagaggaagtggagggcgctggccggccgtggggcaatgcaacggcctcccagcacagggctataagaggagccgggcgggcacggaggggcagagaccccggagccccagccccaccatgaccctcggccgccgactcgcgtgtcttttcctcgcctgtgtcctgccggccttgctgctggggggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgt

SEQ ID NO: 9381 - DNA, 920 bp, Homo sapiens
gcacggaggggcagagaccccggagccccagccccaccatgaccctcggccgccgactcgcgtgtcttttcctcgcctgtgtcctgccggccttgctgctggggggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgt

SEQ ID NO: 9382 - DNA, 3938 bp, Homo sapiens
gggaggggagccagcagggaggaggaggccagggcccgccccacagccactctcgcgcctccgaacagccacaggggcaaagccctgtcacccccaggatccggtcatcagggaaagaggacagggagaccagaagagggccagctgggacgagggggcggacgcccaggaggcaacttctgagacgcagctcctgagaggggcagggaccaggcgcgggaggccagagggggcacagagaacaaaccccctcagaagtgaagaggagagcggaaggaaccgagaggggacggacaggagctgaggaggaaagaggaggggagaggggtcaggccaggcagccaaggagaagacgtgtggccgggggctatcagaaggaaactgggacggacgggccgggctcgggctgtcctgtggagcagcagcatccccggggccggcagaggcgccagtggctgggcgggatgagtctctgagggccactgtggagcgccccgccatggccccccgcaccctctggagctgctacctctgctgcctgctgacggcagctgcaggggccgccagctaccctcctcgaggtttcagcctctacacaggttccagtggggccctcagccccggggggccccaggcccagattgccccccggccagccagccgccacaggaactggtgtgcctacgtggtgacccggacagtgagctgtgtccttgaggatggagtggagacatatgtcaagtaccagccttgtgcctggggccagccccagtgtccccaaagcatcatgtaccgccgcttcctccgccctcgctaccgtgtggcctacaagacagtgaccgacatggagtggaggtgctgtcagggttatgggggcgatgactgtgctgagagtcccgctccagcgctggggcctgcgtcttccacaccacggcccctggcccagcctgcccgccccaacctctctggctccagtgcaggcagccccctcagtggactggggggagaaggtcctggggagtcagagaaggtgcagcagctggaggaacaggtgcagagcctgaccaaggagctgcaaggcctgcggggcgtcctgcaaggactgagcgggcgcctggcagaggatgtgcagagggctgtggagacggccttcaacgggaggcagcagccagctgacgcggctgcccgccctggggtgcatgaaaccctcaatgagatccagcaccagctgcagctcctggacacccgcgtctccacccacgaccaggagctgggtcacctcaacaaccatcatggcggcagcagcagcagtgggggcagcagggccccagccccagcctcagcccctccgggccccagtgaggagctgctgcggcagctggagcagcggttgcaggagtcctgctccgtgtgcctggccgggctagatggcttccgccggcagcagcaggaggacagggagcggctgcgagcgatggagaagctgctggcctcggtggaggagcggcaacggcacctcgcagggctggcggtgggccgcaggccccctcaggaatgctgctctccagagctgggccggcgactggcagagctggagcgcaggctggatgtcgtggccggctcagtgacagtgctgagtgggcggcgaggcacagagctgggaggagccgcggggcagggaggccaccccccaggctacaccagcttggcctcccgcctgtctcgcctggaggaccgcttcaactccaccctgggcccttcggaggagcaggaggagagctggcctggggctcctggggggctgagccactggctgcctgctgcccggggccgactagagcagttgggggggctgctggccaatgtgagcggggagctgggggggcggttggatctgttggaggagcaggtggcaggggccatgcaggcatgcgggcagctctgctctggggcccctggggagcaggactctcaagtcagcgagatcctcagtgccttggagcgcagggtgctggacagtgaggggcagctgcggctggtgggctccggcctgcacacggtggaagcagcgggggaggcccggcaggccacgctggagggattacaagaggttgtgggccggctccaggatcgtgtggatgcccaggatgagacagctgcagagttcacactacggctgaatctcactgcggcccggctaggccaactggaggggctgctgcaggcccatggggatgagggctgtggggcctgtggcggagtccaagaggaactaggccgccttcgggatggtgtggagcgctgctcctgccccctgttgcctcctcggggtcctggggctggtccaggtgttgggggcccaagccgtgggcccctggacggcttcagcgtgtttgggggcagctcaggctcagccctgcaggccctgcaaggagagctctctgaggttattctcagcttcagctccctcaatgactcactgaatgagctccagaccactgtggagggccagggcgctgatctggctgacctgggggcaaccaaggaccgtatcatttctgagattaacaggctgcagcaggaggccacagagcatgctacagagagtgaagagcgcttccgaggcctagaggagggacaagcacaggccggccagtgccccagcttagaggggcgattgggccgtcttgagggtgtctgtgaacggttggacactgtggctgggggactgcagggcctgcgcgagggcctttccagacacgtggctgggctctgggctgggctccgggaaaccaacaccaccagccagatgcaggcagccctgctggagaagctggtcgggggacaggcgggcctgggcaggcggctgggtgcccttaacagctccctgcagctcctggaggaccgtctgcaccagctcagcctgaaggacctcactgggcctgcaggagaggctgggcccccagggcctcctgggctgcagggacccccaggccctgctggacctccaggatcaccaggcaaggacgggcaagagggccccatcgggccaccaggtcctcaaggtgaacagggagtggagggggcaccagcagcccctgtgccccaagtggcattttcagctgctctgagtttgccccggtctgaaccaggcacggtccccttcgacagagtcctgctcaatgatggaggctattatgatccagagacaggcgtgttcacagcgccactggctggacgctacttgctgagcgcggtgctgactgggcaccggcacgagaaagtggaggccgtgctgtcccgctccaaccagggcgtggcccgcgtagactccggtggctacgagcctgagggcctggagaataagccggtggccgagagccagcccagcccgggcaccctgggcgtcttcagcctcatcctgccgctgcaggccggggacacggtctgcgtcgacctggtcatggggcagctggcgcactcggaggagccgctcaccatcttcagcggggccctgctctatggggacccagagcttgaacacgcgtagactggggtcccgcccgacgtgtctacgtcggctgaagagacagcgggggcggcgggctcctggggtctcgcctgagacggggcacctagccctgggcgagcgccgcacccgggcccgcagcggcaccgcgcccagagcggcctctccccacgcccggggcgcgccggctcagggaggctcggggccgcccatgcagacttttggcctggcgcgatcccccaagaacccctccagggccggcctgcggaggagccgatcctcgcaccctccgctccctccactggccctccaggtcgattccctgggctccaggctcccccgcgcgggcgccgcccaccgccatactaaacgatcgaggaataaagacacttggtttttctaaaaaaaa

SEQ ID NO: 9383 - DNA, 2389 bp, Homo sapiens
gtcaggccaggcagccaaggagaagacgtgtggccgggggctatcagaaggaaactgggacggacgggccgggctcgggctgtcctgtggagcagcagcatccccggggccggcagaggcgccagtggctgggcgggatgagtctctgagggccactgtggagcgccccgccatggccccccgcaccctctggagctgctacctctgctgcctgctgacggcagctgcaggggccgccagctaccctcctcgaggtttcagcctctacacaggttccagtggggccctcagccccggggggccccaggcccagattgccccccggccagccagccgccacaggaactggtgtgcctacgtggtgacccggacagtgagctgtgtccttgaggatggagtggagacatatgtcaagtaccagccttgtgcctggggccagccccagtgtccccaaagcatcatgtaccgccgcttcctccgccctcgctaccgtgtggcctacaagacagtgaccgacatggagtggaggtgctgtcagggttatgggggcgatgactgtgctgagagtcccgctccagcgctggggcctgcgtcttccacaccacggcccctggcccagcctgcccgccccaacctctctggctccagtgcaggcagccccctcagtggactggggggagaaggtcctggggagtcagagaaggtgcagcagctggaggaacaggtgcagagcctgaccaaggagctgcaaggcctgcggggcgtcctgcaaggactgagcgggcgcctggcagaggatgtgcagagggctgtggagacggccttcaacgggaggcagcagccagctgacgcggctgcccgccctggggtgcatgaaaccctcaatgagatccagcaccagctgcagctcctggacacccgcgtctccacccacgaccaggagctgggtcacctcaacaaccatcatggctgacctgggggcaaccaaggaccgtatcatttctgagattaacaggctgcagcaggaggccacagagcatgctacagagagtgaagagcgcttccgaggcctagaggagggacaagcacaggccggccagtgccccagcttagaggggcgattgggccgtcttgagggtgtctgtgaacggttggacactgtggctgggggactgcagggcctgcgcgagggcctttccagacacgtggctgggctctgggctgggctccgggaaaccaacaccaccagccagatgcaggcagccctgctggagaagctggtcgggggacaggcgggcctgggcaggcggctgggtgcccttaacagctccctgcagctcctggaggaccgtctgcaccagctcagcctgaaggacctcactggtgaggggacaaaagggcctgcaggagaggctgggcccccagggcctcctgggctgcagggacccccaggccctgctggacctccaggatcaccaggcaaggacgggcaagagggccccatcgggccaccaggtcctcaaggtgaacagggagtggagggggcaccagcagcccctgtgccccaagtggcattttcagctgctctgagtttgccccggtctgaaccaggcacggtccccttcgacagagtcctgctcaatgatggaggctattatgatccagagacaggcgtgttcacagcgccactggctggacgctacttgctgagcgcggtgctgactgggcaccggcacgagaaagtggaggccgtgctgtcccgctccaaccagggcgtggcccgcgtagactccggtggctacgagcctgagggcctggagaataagccggtggccgagagccagcccagcccgggcaccctgggcgtcttcagcctcatcctgccgctgcaggccggggacacggtctgcgtcgacctggtcatggggcagctggcgcactcggaggagccgctcaccatcttcagcggggccctgctctatggggacccagagcttgaacacgcgtagactggggtcccgcccgacgtgtctacgtcggctgaagagacagcgggggcggcgggctcctggggtctcgcctgagacggggcacctagccctgggcgagcgccgcacccgggcccgcagcggcaccgcgcccagagcggcctctccccacgcccggggcgcgccggctcagggaggctcggggccgcccatgcagacttttggcctggcgcgatcccccaagaacccctccagggccggcctgcggaggagccgatcctcgcaccctccgctccctccactggccctccaggtcgattccctgggctccaggctcccccgcgcgggcgccgcccaccgccatactaaacgatcgaggaataaagacacttggtttttct

SEQ ID NO: 9384 - DNA, 1473 bp, Homo sapiens
aagcccggaggtgggaacatcgcagtgttcagagaacatcgtgtgttcaaagaaccacgtgggttctttagggacaagaaggctgagatgggtagtggtggcaggagtgctcaggtgtccactgggcagagggcttggctgttaccctgcagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggacacagcttgggctatggctttgtgaactacgtgaccgcgaaggatgcagagagagcgatcaacacgctgaacggcttgaggctccagtcaaaaaccattaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacaggtttgtccagaggggttgcgtttatccggtttgacaaacggtcggaggcagaagaggcaattaccagtttcaatggtcataaacccccaggttcctctgagcccatcacagtgaagtttgcagccaaccccaaccagaacaaaaacgtggcactcctctcgcagctgtaccactcgccagcgcgacggttcggaggccccgttcaccaccaggcgcagagattcaggttctcccccatgggcgtcgatcacatgagcgggctctctggcgtcaacgtgccaggaaacgcctcctccggctggtgcattttcatctacaacctggggcaggatgccgacgaggggatcctctggcagatgtttgggccgtttggtgccgtcaccaatgtgaaagtgatccgcgacttcaacaccaacaagtgcaaagggtttggctttgtgaccatgacaaactatgaagaagccgcgatggccatagccagcctgaacggctaccgcctgggggacaaaatcttacaggtttccttcaaaaccaacaagtcccacaaataactcgctcatgcttttttttgtacggaatagataattaagagtgaaggagttgaaacttttcttgttagtgtacaactcattttgcgccaattttcacaagtgtttgtctttgtctgaatgagaagtgagaaggtttttatactctgggatgcaaccgacatgttcaaatgtttgaaatcccacaatgttagaccaatcttaagtttcgtaagttatttcctttaagatatatattaaacagaaatctaagtagaactgcattgactaaccagtccctctggatggtggtgaacctgaagcatgctttaacctctaagactgtct

SEQ ID NO: 9385 - DNA, 6057 bp, Homo sapiens
ggtcgtgcgcgctgaggaggagccgctgccgccgtcgccgtcgccgccaccgccgccaccgctaccgaggccgagcggagccgttagcgccgcgccgccgccgcctcccgcccgccccggagcagccccgggcccgcccgcccgcatccagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggacacagcttgggctatggctttgtgaactacgtgaccgcgaaggatgcagagagagcgatcaacacgctgaacggcttgaggctccagtcaaaaaccattaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacaggtttgtccagaggggttgcgtttatccggtttgacaaacggtcggaggcagaagaggcaattaccagtttcaatggtcataaacccccaggttcctctgagcccatcacagtgaagtttgcagccaaccccaaccagaacaaaaacgtggcactcctctcgcagctgtaccactcgccagcgcgacggttcggaggccccgttcaccaccaggcgcagagattcaggttctcccccatgggcgtcgatcacatgagcgggctctctggcgtcaacgtgccaggaaacgcctcctccggctggtgcattttcatctacaacctggggcaggatgccgacgaggggatcctctggcagatgtttgggccgtttggtgccgtcaccaatgtgaaagtgatccgcgacttcaacaccaacaagtgcaaagggtttggctttgtgaccatgacaaactatgaagaagccgcgatggccatagccagcctgaacggctaccgcctgggggacaaaatcttacaggtttccttcaaaaccaacaagtcccacaaataactcgctcatgcttttttttgtacggaatagataattaagagtgaaggagttgaaacttttcttgttagtgtacaactcattttgcgccaattttcacaagtgtttgtctttgtctgaatgagaagtgagaaggtttttatactctgggatgcaaccgacatgttcaaatgtttgaaatcccacaatgttagaccaatcttaagtttcgtaagttatttcctttaagatatatattaaacagaaatctaagtagaactgcattgactaaccagtccctctggatggtggtgaacctgaagcatgctttaacctctaagactgtctaacacgcgtttcattcaatgtctccacagactgggtagcaaaaaaatcaccttttagttttagtttttaatctaaagatgttagacagatgctgagtgtgcgttttctcaaccgcttcaacattgtaagcgatgtatgctttggttgacaggaagttccttttccaggcaggtcccgttgccacctcctgctcactcagtcccgggctctgccgagtggtcctgggaatggcggcgggcccgtccagcgtgggccaccactggggccgggggccacgggctgcatgctgggcgggccctccagagaaggacacaaacgtgtttcgtaagcccaggcaccaatgggaatggaccaaagagtttcagggaaactccagtatattccagagtcagatctaagctccaggcacgcctgaagatgtgttgctactctgacatcccgagtttctgtccacacattgcatgcacagcgccccacacattggatactgttgttcacgataatttctcccgttttccagagcatttaacatagcttggaggcgtaaaatggctctgtattttaataacacagaaacatttgagcattgtatttctcgcatcccttctcgtgagcgcttagacctttttctattttagtcggattttgttttggaattttgcttttgtatgaacactcagcagaaaagtacttacttcttgccagttatctattaaccaaaacctttgatttgtagttttaaagattaaccctcaaagttctcttcataactgccttgacattttgggttgttctgttctgttaattttcttttgcttttttgtgttttttgtttgtttttacttttgcatttaagaccattaaatttgattttgttttgctcgaattttgttttgttttttattttaccttttctttctttttggctagggaaggtgcaggtggcccagcattcagggaggagtcgtaagatcttaagaaaccaatccttgcctcaagcaaaagcatttctgaatctgtgacgcaagaatgtgcagttacaggctggtggcttttaaaccaggagcccggaggaagggtgaaagagaaagcctgtgaaataggcagggccagatcacccaaaactcctcaggactgggatctggcgtttataaataactagtttacagagagaatcacaaacaggataacttagtaccagcagtttttaaccttgacgtgagactaaaacgtgaccgtaggctgttttttagttattgctctcatgagatgatggctgtatttatctgtttatttatacctatttatgtatttatttattgaagtgtgaaattgagcaataggcaggcaccaccgtccccagagcaggtcagcgtctcgagaggcccctggacaattgaggatgcccatcccctcccctttccctgatcttttactgaggggctgtgtgcgcgatccttgcaaattgatgatgttgccatccgtacccaggctgtgtctcataaaagtcggcctggtgccagagaggacctcctttctcccacagaatcccagatcctcaggaaaagccaaaaccgaggcccattgcccggattcgacacaaaagagggtccctgctctgttgcccgagagcagtctgcatcctgggaccagaatgctttcctggaaaaagaagcctttcaggtttccctgggccagcatcttctgatggaaggtgggagccaacacccttctgatggaaggtgggagccaacacccttctgatggaaggtgggagccaacacccttctgatggaaggtgggagccaacacccttctgatggaaggtgggagccaacacccttctgatggaaggcgggattcccgcttctgaaactccccctggagtctcactcccacacatgcccatagctagcattcaacagagaactctgtcttaagcttcaactgtgaaaatgatgacgggcttgtagcacctcagcttctttcctcgcccccttttatctgaatcctatcaattattctgatgctgggacaggtgagaagaaactgtgaagtatatgagcctttgaaagttccctgaagtttctcagttcaggaacattctcattgtatgtggtctccgctgtttgaacagccttctagctaaaaaattccaaagcctttatttgggagtcttagcttgcaagcttgtggaaggatttagcttaacaactgtcactcctgaaaagcaatctctgttccatcaaggttctagttgctggccctgtgtcctcaaagttcattacatcttatcaaggcctgtttgcaaaggggagatcccttttcttaaaaaaggctcaacccaaaagaaaccatttcttaaaaaattttacatagatcagttgtatttctatttagcaaaaatgagtgctctgcttttatttgggaatttcgatgaaaaagcgttcagagtagataatgttcatttatcaaaaatctggtttgggaaataccaaagaggctttgattgaattcccttttgacccgtgtgtaacttcctctggtagttagaccccaggcagctccgaatttgtgaacctgcttcctgatgaattctcccttgttcccccttggctctgccattatttcgttttcagtgtaatttgccaagccgcagttttctgtgctggctgtgcctctagtcgcagctctgtgactgattccctcccgggtgctgagtcccctccccggccaccatcctgcgtgaatatcctgaaattcatgggcttcctcgggggcccgcccgcaggtggtgctgggtgggttccgccaccttctcctggaaggtgagccttttcctggccaagggcagctgccttaacctctgagagtctgcgcttggccttagtcctggagacccagcctccagggactgaaccgtgctgctgttgggagccaagaccggccctttggagccggcagcccaggggtccctgctggatcagagaaatagaagcacccgaagacggttagtggcaattccttgacccggtttgcttccaaatgaaggccatttgtccaccaggcattgaaaagacatgacttacccagtccggcatcggacttgaaaaatcgaaattgacatcactcagctgttacatttcacatccgattcagcccccttttatttccatgtgcttttcgcagccttcctgtgttggatgaaagagaataagaattcagctgacaggaggcctctatcctgtccctccaccccaccctccacctcaatcccctcccatcttccccagacctacctcacctactaggacctgaggcagctccttagcagagacccctggggtttagctgactctgggggtcaggggttcctgtccccaaacttcgcaagacagccctgaagtcacaagtgctttcttttaagtggcattggcaattggcgtgtaatgatggcagtagaatctgaatctcggatcccaggcagggttcacatttccaaacctttttgatttcccctgacctctaatggctggatcctatttttctacaacctttcagtgacatcgttcaggtttctttcttggccatttaaaaaaacaaattttttttttctcacttgtaagtcaccgccagtacctaagttaggctaacggagactttgacaggactggatttttcttccaccagaagagaagccttttccgttggtttggggccacctctttgaccatgaccatgtgatgttccgtttacagtgacttgctttgggggaggggaggctctcttaaccgattcccatgttgtacagtagatggttagaccttttgtatattagtgtgttttaagttattgatttgttttatataaaataatttatttttcaggtgccatttttcattttaactttgtttttacatgggtttgttttcaataaagtctgacactggtgtccaaaagtcaacaataaaatgaatcccattgtgttcttttgaagatgcctatgtaacttttaagctttttaaattattttcagaaaaaaaaaaagaaaagcccttatcagttttccatcagcccattgcctttttattttttttttttaatccttgtgaataaatgttctttagtgttttaggaggaaaaagcaaacctagattttgataacccagaagacttcagattaataaagaagctttgaaagaagaccatttttcaaaattttagtgaagtgtgaatattttttgtcaatggctttctcaaagagaatgaaacttttgcaccattttcagagtttttatagagatgccaaattgatatatttacatgtaatggaaacatgaaaaagttttattaaacaattgttcatagctgtgtagacattttaattcagtttccaaagctctcaaaaaatcgtatttttgaagtacggagtgatgcggtttggggcgtggcttacagttccaacgactcaattgtcccgatactcagttctttctacaggtatcaggttcgtgttaaacgctgtatgttaactatgactggaattctgtgatattttggtaataaatgaagtgggatcattgcg

SEQ ID NO: 9386 - DNA, 3760 bp, Homo sapiens
agtccgaactctgggcgggaacactggtgggggcggcggaggttgtgcccgcgaagttcctagagctcagcccgttgcggcgggagtagagagaattgggcgcctcgggaggtggcaccgcccctcccgtgggcacaagcaggttgggggcggcgggagccgagcggggacagtcgcgcctggcagcgtgcacgggcgtggacgtgcccgggtgcggccgcgtgtagcgcaagaaggaaactgttgagacgcaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatagctagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgtttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttataaaaaagaaaatttggagaaactttttactggtcctggaacaaatattttgacttgaatactttgagaaatctcttcatatgacacctagtgagcttttaaaatttaccaggaaatttgcagcggttggaaaatttagaaagatttatggtgtagaaaatacttttgagatctttgtatgaaaggagtagaatcaatggggggaaacactgctggtttcatttttgtaatcaccagtggagcgtctgatcatcctggttattatgtgataggtggctcacattgatttgtgattttgaaacaaataaaaaaaatttacaaaagaatatataagagcaggcaagaaatttaaattaccgagagatgggggaaaaaatctgttcttcctaaagaaatcccttcagatagagctcatggtgtttagtgatgtacttgcagtattgtttgaagaattgttttgtcttaaggaaaaaagacgttgcacatgatttgtactgcagcaaatcagcaaaagtgatctgagttggatatatttgaaggtattttgaaagttacgttcaaggctaacacctgagctttgtgtaatgtaaataagaccttgtgtttatgaacctttcagctaatttaattttttttcccttacatgccaagtgatgttcaggttttgaatgtttttgtatcagttttttcctttgtaaatggcattaacattgttacttgaggtcttgcttaatcacttttgttgtcctgaggacttgaatttacagtgcatcagatttgttgcaaattttgtctgtagatagtctagcttcagctgtttatggtgatgctacattttggtttataaatatgtttgtggtataaaaaaatgagtataaccataggttttgaacaaatttccttacatttttcatacaaaaatcataaatatctgtatgctattgaaatttaactttgtatgatgcttaaaaaccactatttggggaaataataaaataagtctttaccatgtatgaaagaaattttaaaaaatacaaaatattttctgattagcatctagcttataataaattttcaaaaaagctgaaggcaaaaatgccttcatcaggatgcactgagaactatatagttacgtcctgctttttgtataaactgagatgctcacatgcttccccttagaacaggcaatgtgctatgcataacatagttgtacattatctttgcggttgctttgagttttattttttattatttaaaattgtagttataaaatttttcagtatagtacagtacatatactgtgaggcgcgtgctaaagtgaataagcgagttttcatgctgacccactcaatgctattcagaaatcaattggcttagcactttctcatatccttaggtgcatttagattgccagagttaaccttctgcgtttaaaaaaagaaaaacactaaaaaataaaatacatgtatatacttaaaaaaaaataataaggtttccctcaagggaaaacagcagctacatgcttctttcctatactactgtagcaaaccaaggcattgatgagagggcatgcaaattgtgcttcactttacagtgttttatcagagcacttaataaaatgtaaggctggtatttatttgaagttgtacagtatgacttaattcacatctgttggaatagaaaatatattctgttgagtatttaagaggctgtacatgttttcttttgtgtttggattctttgtactttttcatgttcagtacatcaataaacaaagttgaagggaaa

SEQ ID NO: 9387 - DNA, 1720 bp, Homo sapiens
attgcagacggcaactccaaactaacatggcagtcagactgtgtgatgtggcttctctgcttagaagtggttcgtgggcagcagagccttggaccggggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttggacaatctgctcaatatggcttatggagtaaagaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatagctagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgtttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttttcctttttctgattagctttgtgtttggtttacatttaaagcattgctgttatgtctgtttaagaaaagtattttgaagtttacatttttatttatgaagtttaaaacagtatttattttgtaattat

SEQ ID NO: 9388 - DNA, 3760 bp, Homo sapiens
agtccgaactctgggcgggaacactggtgggggcggcggaggttgtgcccgcgaagttcctagagctcagcccgttgcggcgggagtagagagaattgggcgcctcgggaggtggcaccgcccctcccgtgggcacaagcaggttgggggcggcgggagccgagcggggacagtcgcgcctggcagcgtgcacgggcgtggacgtgcccgggtgcggccgcgtgtagcgcaagaaggaaactgttgagacgcagcaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatagctagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgtttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttataaaaaagaaaatttggagaaactttttactggtcctggaacaaatattttgacttgaatactttgagaaatctcttcatatgacacctagtgagcttttaaaatttaccaggaaatttgcagcggttggaaaatttagaaagatttatggtgtagaaaatacttttgagatctttgtatgaaaggagtagaatcaatggggggaaacactgctggtttcatttttgtaatcaccagtggagcgtctgatcatcctggttattatgtgataggtggctcacattgatttgtgattttgaaacaaataaaaaaaatttacaaaagaatatataagagcaggcaagaaatttaaattaccgagagatgggggaaaaaatctgttcttcctaaagaaatcccttcagatagagctcatggtgtttagtgatgtacttgcagtattgtttgaagaattgttttgtcttaaggaaaaaagacgttgcacatgatttgtactgcagcaaatcagcaaaagtgatctgagttggatatatttgaaggtattttgaaagttacgttcaaggctaacacctgagctttgtgtaatgtaaataagaccttgtgtttatgaacctttcagctaatttaattttttttcccttacatgccaagtgatgttcaggttttgaatgtttttgtatcagttttttcctttgtaaatggcattaacattgttacttgaggtcttgcttaatcacttttgttgtcctgaggacttgaatttacagtgcatcagatttgttgcaaattttgtctgtagatagtctagcttcagctgtttatggtgatgctacattttggtttataaatatgtttgtggtataaaaaaatgagtataaccataggttttgaacaaatttccttacatttttcatacaaaaatcataaatatctgtatgctattgaaatttaactttgtatgatgcttaaaaaccactatttggggaaataataaaataagtctttaccatgtatgaaagaaattttaaaaaatacaaaatattttctgattagcatctagcttataataaattttcaaaaaagctgaaggcaaaaatgccttcatcaggatgcactgagaactatatagttacgtcctgctttttgtataaactgagatgctcacatgcttccccttagaacaggcaatgtgctatgcataacatagttgtacattatctttgcggttgctttgagttttattttttattatttaaaattgtagttataaaatttttcagtatagtacagtacatatactgtgaggcgcgtgctaaagtgaataagcgagttttcatgctgacccactcaatgctattcagaaatcaattggcttagcactttctcatatccttaggtgcatttagattgccagagttaaccttctgcgtttaaaaaaagaaaaacactaaaaaataaaatacatgtatatacttaaaaaaaaataataaggtttccctcaagggaaaacagcagctacatgcttctttcctatactactgtagcaaaccaaggcattgatgagagggcatgcaaattgtgcttcactttacagtgttttatcagagcacttaataaaatgtaaggctggtatttatttgaagttgtacagtatgacttaattcacatctgttggaatagaaaatatattctgttgagtatttaagaggctgtacatgttttcttttgtgtttggattctttgtactttttcatgttcagtacatcaataaacaaagttgaaggg

SEQ ID NO: 9389 - DNA, 2370 bp, Homo sapiens
gagcctggcagagcagctgcacacacggcagtgcggaggcagagaaggggttggtgatacggtgctataaatctgtggtccagtccacctcccttttaagacgtcctcccccctatttctgttcttagttagagatgcagcagcttactcctgtagcgacctactaaaaagcaacaaggagaaagacatcgtctttttgaaaaaacgttctttcgtctcttttctttgttccttggtttgtttttcttgcccctttttgtttagttgaacggcaataggagggtagtctctccgtctttttaaactcttttttaagtttcccctcccctttcatattttttttcgccatttcttttagcattggactttggggtcgaaagcgtttctttttatttgcttcttttaagccgagcacagtttaggtttcgtgctgtcttaagagaactatccagcagcttcttgctcatccttattgggagaactgcaccgttactttaaaaacacacatacacaaaaaccttaagggagaaaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttggacaatctgctcaatatggcttatggagtaaagaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatagctagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgtttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttataaaaaagaaaatttggagaaactttttactggtcctggaacaaatattttgacttgaatactttgagaaatctcttcata

SEQ ID NO: 9390 - DNA, 3805 bp, Homo sapiens
caataggagggtagtctctccgtctttttaaactcttttttaagtttcccctcccctttcatattttttttcgccatttcttttagcattggactttggggtcgaaagcgtttctttttatttgcttcttttaagccgagcacagtttaggtttcgtgctgtcttaagagaactatccagcagcttcttgctcatccttattgggagaactgcaccgttactttaaaaacacacatacacaaaaaccttaagggagaaagcaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttggacaatctgctcaatatggcttatggagtaaagaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatagctagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgtttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttataaaaaagaaaatttggagaaactttttactggtcctggaacaaatattttgacttgaatactttgagaaatctcttcatatgacacctagtgagcttttaaaatttaccaggaaatttgcagcggttggaaaatttagaaagatttatggtgtagaaaatacttttgagatctttgtatgaaaggagtagaatcaatggggggaaacactgctggtttcatttttgtaatcaccagtggagcgtctgatcatcctggttattatgtgataggtggctcacattgatttgtgattttgaaacaaataaaaaaaatttacaaaagaatatataagagcaggcaagaaatttaaattaccgagagatgggggaaaaaatctgttcttcctaaagaaatcccttcagatagagctcatggtgtttagtgatgtacttgcagtattgtttgaagaattgttttgtcttaaggaaaaaagacgttgcacatgatttgtactgcagcaaatcagcaaaagtgatctgagttggatatatttgaaggtattttgaaagttacgttcaaggctaacacctgagctttgtgtaatgtaaataagaccttgtgtttatgaacctttcagctaatttaattttttttcccttacatgccaagtgatgttcaggttttgaatgtttttgtatcagttttttcctttgtaaatggcattaacattgttacttgaggtcttgcttaatcacttttgttgtcctgaggacttgaatttacagtgcatcagatttgttgcaaattttgtctgtagatagtctagcttcagctgtttatggtgatgctacattttggtttataaatatgtttgtggtataaaaaaatgagtataaccataggttttgaacaaatttccttacatttttcatacaaaaatcataaatatctgtatgctattgaaatttaactttgtatgatgcttaaaaaccactatttggggaaataataaaataagtctttaccatgtatgaaagaaattttaaaaaatacaaaatattttctgattagcatctagcttataataaattttcaaaaaagctgaaggcaaaaatgccttcatcaggatgcactgagaactatatagttacgtcctgctttttgtataaactgagatgctcacatgcttccccttagaacaggcaatgtgctatgcataacatagttgtacattatctttgcggttgctttgagttttattttttattatttaaaattgtagttataaaatttttcagtatagtacagtacatatactgtgaggcgcgtgctaaagtgaataagcgagttttcatgctgacccactcaatgctattcagaaatcaattggcttagcactttctcatatccttaggtgcatttagattgccagagttaaccttctgcgtttaaaaaaagaaaaacactaaaaaataaaatacatgtatatacttaaaaaaaaataataaggtttccctcaagggaaaacagcagctacatgcttctttcctatactactgtagcaaaccaaggcattgatgagagggcatgcaaattgtgcttcactttacagtgttttatcagagcacttaataaaatgtaaggctggtatttatttgaagttgtacagtatgacttaattcacatctgttggaatagaaaatatattctgttgagtatttaagaggctgtacatgttttcttttgtgtttggattctttgtactttttcatgttcagtacatcaataaacaaagttgaaggg

SEQ ID NO: 9391 - DNA, 777 bp, Homo sapiens
ggctcacgcctgtaatcccagcacattgggaggccgaggttggcagatcagttgaagccaggagttcgagacgagcctggccaacgtggcgaaaccctgtctctactaaaaatacaaaaaaatagctgggtgtggtgatgcatgcctgtaatcccagctacttgggaggccgaggcagaagaatcgcttgaacccaggaggtggaagttgcagtgatccgagatcatgcccactgccatccagtctggatgacagagagagagaccttgcctcaaaagaagaaagatttgaattaatggtttgaaaattcttagaacacttgaccacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggta

SEQ ID NO: 9392 - DNA, 723 bp, Homo sapiens
gctttcttcccttgcctttgaagactttctgcaggccctggaattgcctttgttcctctgtctgcccactttgccagtgtgaagcaggttttcatgggattctactggggtaaaccaaaagcagcagaaaaagtgtgaacaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaa

SEQ ID NO: 9393 - DNA, 3789 bp, Homo sapiens
acaaacggcgggaccgcggcgcctgggcgtcactgaggcagtagccggccgggtgaggagggcggttgccggcgcggcgcggcgcggcgcgggtggggcgggggttccgccggcttccagtcccctttcccgccgccgccgccgccaccgcctctccgcggagctcgccccgagcgactcctccgcggcagtgctgacggccagcggcacgagccgtagtagctgcagcttcgagtcacagcagcaggtaattgctgccatggaaacacaactgtctaatgggccaacttgcaataacacagccaatggtccaaccaccataaacaacaactgttcgtcaccagttgactctgggaacacagaagacagcaagaccaacttaatagtcaactaccttcctcagaacatgacacaggaggaactaaagagtctctttgggagcattggtgaaatagagtcctgtaagcttgtaagagacaaaataacagggcagagcttgggatatggctttgtgaactacattgaccccaaggatgcagagaaagctatcaacaccctgaatggattgagacttcaaaccaaaacaataaaagtttcctatgctcgcccaagttcagcttctatcagagatgcaaatttatatgtcagcggacttccaaaaacaatgacccagaaggagttggaacagcttttttcacaatatggacgcattattacttctcgtattcttgtcgaccaggtcactggcatatcaaggggtgtagggtttattcgatttgacaagcgaattgaggcagaagaagctatcaaaggcctaaatggccagaaacctcccggtgccacggagccaatcactgtaaagtttgctaataacccaagccaaaaaaccaatcaggccatcctttcccagctgtaccagtctccaaacagaaggtatccaggaccgctagctcagcaggcacagcgttttaggttggacaatctgctcaatatggcttatggagtaaagaggttttctccaatgaccattgacggaatgaccagtttggctggaattaatatccctgggcaccctggaacagggtggtgtatatttgtgtacaacctggctcctgacgcagatgagagtatcctgtggcaaatgtttgggccttttggagctgtcaccaatgtgaaggtcatccgtgactttaacaccaataaatgcaaaggttttggatttgtgactatgacaaactatgatgaggctgccatggcgatagctagcctcaatggataccgtctgggagacagagtactgcaggtctcctttaagacaaacaaaacgcacaaagcctaatgagctcttgtcctcagtccatttatatatgaaaactatacaacaaaggcaagttaagagaaactttatacattagtaaatgtctttgtaagtcagtgttgagatggggataaaatgactacttagcatcctaagaaatatgtgagattttttattgctagtatttgaattaaaacttcttaaatatcttttatgtttgaatatggacaagaggtacagggtttttacctgtcacattgcattctattgccttctttgaagaaggtggaccttttaaagtgtttcagctaagggaagacatttcttttctttttacataactgccttgaacctgtgagtaaatattgaggctttgtgttgtaattcttcagttggttgtgtcttttttttcccccctttttttcctttttctgattagctttgtgtttggtttacatttaaagcattgctgttatgtctgtttaagaaaagtattttgaagtttacatttttatttatgaagtttaaaacagtatttattttgtaattatgatttgggttggggaagggggggctacattataaacgcttattgtaagaatactggagaacttttcgtaaagcagtaccttgccaaagagataagagcctctttgatgtgggtttaaaaaaagcatctatttttataaaaaagaaaatttggagaaactttttactggtcctggaacaaatattttgacttgaatactttgagaaatctcttcatatgacacctagtgagcttttaaaatttaccaggaaatttgcagcggttggaaaatttagaaagatttatggtgtagaaaatacttttgagatctttgtatgaaaggagtagaatcaatggggggaaacactgctggtttcatttttgtaatcaccagtggagcgtctgatcatcctggttattatgtgataggtggctcacattgatttgtgattttgaaacaaataaaaaaaatttacaaaagaatatataagagcaggcaagaaatttaaattaccgagagatgggggaaaaaatctgttcttcctaaagaaatcccttcagatagagctcatggtgtttagtgatgtacttgcagtattgtttgaagaattgttttgtcttaaggaaaaaagacgttgcacatgatttgtactgcagcaaatcagcaaaagtgatctgagttggatatatttgaaggtattttgaaagttacgttcaaggctaacacctgagctttgtgtaatgtaaataagaccttgtgtttatgaacctttcagctaatttaattttttttcccttacatgccaagtgatgttcaggttttgaatgtttttgtatcagttttttcctttgtaaatggcattaacattgttacttgaggtcttgcttaatcacttttgttgtcctgaggacttgaatttacagtgcatcagatttgttgcaaattttgtctgtagatagtctagcttcagctgtttatggtgatgctacattttggtttataaatatgtttgtggtataaaaaaatgagtataaccataggttttgaacaaatttccttacatttttcatacaaaaatcataaatatctgtatgctattgaaatttaactttgtatgatgcttaaaaaccactatttggggaaataataaaataagtctttaccatgtatgaaagaaattttaaaaaatacaaaatattttctgattagcatctagcttataataaattttcaaaaaagctgaaggcaaaaatgccttcatcaggatgcactgagaactatatagttacgtcctgctttttgtataaactgagatgctcacatgcttccccttagaacaggcaatgtgctatgcataacatagttgtacattatctttgcggttgctttgagttttattttttattatttaaaattgtagttataaaatttttcagtatagtacagtacatatactgtgaggcgcgtgctaaagtgaataagcgagttttcatgctgacccactcaatgctattcagaaatcaattggcttagcactttctcatatccttaggtgcatttagattgccagagttaaccttctgcgtttaaaaaaagaaaaacactaaaaaataaaatacatgtatatacttaaaaaaaaataataaggtttccctcaagggaaaacagcagctacatgcttctttcctatactactgtagcaaaccaaggcattgatgagagggcatgcaaattgtgcttcactttacagtgttttatcagagcacttaataaaatgtaaggctggtatttatttgaagttgtacagtatgacttaattcacatctgttggaatagaaaatatattctgttgagtatttaagaggctgtacatgttttcttttgtgtttggattctttgtactttttcatgttcagtacatcaataaacaaagttgaaggg

SEQ ID NO: 9394 - DNA, 4682 bp, Homo sapiens
ggacttgaacacacgggaccggacaggaccgaccgaggggcggcggcgaaaggcagagcgccgcgatctctgtcgggaagcgcaacctccccgggccccgcggggccgcgcagggggcgtcctcaaccccgcgcccgctccctctttccatcccctgccgcccgcaggccaccccggggcccggccatccgcgcgcgcatccccgggttcgggcccgtccctggccctcgagggagccgccgccttcatcgccacatctgcagcggccgcaccagaggccgcccgggcgggaccccagcgtgagcatcgggcgcccccctaggagtgcaccacccccggagcccccctcaacacggaccgcgcccgccgggcacacaagaatggtcactcagatactgggggccatggagtctcaggtgggggggggcccggccggcccggccctgcccaacgggccactccttggtacaaatggagccactgacgacagcaagaccaacctcatcgtcaactacctgccccagaacatgacccaggatgagttcaagagtctcttcggcagcattggcgacatcgagtcctgcaagttggttcgggacaagatcacagggcagagccttggctacgggtttgtgaactattctgaccccaatgatgcagacaaagccatcaacaccctcaacggcctcaaattacagacgaagaccatcaaggtgtcctatgccagacccagttcagcatccatccgggatgctaacctgtacgtcagcgggctccccaagaccatgagccagaaagagatggagcagctcttctcccagtacggccgcatcatcacgtcccgcatcctggtggaccaggtcacaggtgtctctcggggtgtgggattcatccgctttgacaagaggattgaggccgaagaggctatcaaaggactgaatgggcagaagccgctgggcgcagctgagcccatcacagtcaagttcgcgaacaacccaagtcagaagacggggcaggcgctgctcacccacctctaccagtcatccgcccggcgctacgcaggccccctacaccatcagacccagcgtttccggctggacaatttgctcaacatggcctacggcgtcaagagtcccctgtcgctcatcgccaggttctcgccgatcgccatcgatggtatgagcggcctggcgggcgtgggcctgtcggggggcgcggcgggcgccggctggtgcatcttcgtgtacaacctgtcaccggaggcagacgagagcgtgctgtggcagctgttcgggccttttggggcagtcaccaacgtcaaggtcatccgtgatttcaccaccaacaagtgcaagggtttcggcttcgtgaccatgaccaactatgacgaggcggccatggccatcgccagcctgaacggctatcgcctgggcgagcgcgtgctgcaggtctccttcaagaccagcaaacagcacaaggcgtgagcccaccccgcctgccctcccaccccctccccgggcagcagagagagagagagagaaagagagagagagagagagaaggggcccaagagagacagcacaggcagccccacggacgacgcgagggccccacgtccctgcggaagccacagggtgagcactctggggtgggagggtctgcagggaattgggggggtgcccggggatcccccgccccatcctcctgcccccaccccaggctgggctgttcactctctcgtcttggtttggttcatggtgaaggtttttgtttcttttttcggctaaaaagaatgcagagatgtgcccccacccccaccctcgaccacccccgatgggatggcttggggggctccagggggtgccctcccagacccccttgcccaggcctccccagcacctaggtggggcctggggtaggaggaacaggtttaaaaatccccaaaaaagcgaaccgtgaggaggggtgtgggcacccccggcccagtgccccctggtggaatgcgggggagcaggcagtggggctggaagcagaaacaaaatgaaaaaaaaaggggggtgggaggggaagaaaaactctatttttgtaaaaagggaaaaagacctcgtggagaatttttactggggattcttgaacttgaaaaaaaaaaacacaaaaaaagacaaaaaaaaaaaaagaaaatattttggcaggttatgtttaccaactggggcgggggtggggggggcccagggagcagggcttaggggctagcagcccacggggccacacagagaaacaaccacgcagacagtcacaccacggggacacacggacagacgcagacggacacagcgacatgccccagacacgttaagggactggttggccaaactcagacacgtggacagggatagacagaaagagacagaagctggggctacgtccatgtggacacagaccacagatgtgggcacacgaatccatccacctgtccacgtgcacacgtgaatgtagcgatagatatttggacatcaaatttggacaccaggtcacggagaaacacaaacaccacccaggaacacgcagacatatgcccatagcatcccacaggcccaggcaggaggtcccaccccagaccctgccccagacgctccctcaccctctcggccccctcgccctggcccccaggttctctgcagagatctctcctggacccccagcggtctccttggcgcccacgaacacaggcgtgcacacgcagcgcacatgcattgagacacacgatacctcgttccaccttggcgtcacggtgggctggaggcagcccccccccccacaacacttgaggccaaaggacacccctgtccccggggctcagcctccccctgggccgaggccttggcccacacagctgagggagaggcccagccctgagcctcccccaccaggactgggcctccccggcagcaagaccccggcactccccgccaggcccagggtggggtggatgggcccaaaggcccagccccacactcctttcccgtccacttgtcacctacctatcccctttcggtttgttgggtttttcgtctttccagattgcagtggacacagcccccgatctcgagccccggcccccggcttctgtctggacattgcatcgccctagttttctttctttaaaaaaaaaaaattccaacagaagccacaggccggagcccctgggagccctcgcaccgctccccaccccactcagcggccccatcggaactgagaattgcaaaacccccgactttagctatagttaagttgccttcccccggtgtccccacgtttggtgtctggctatggcgcccccatctgactgtccagctctctctcccccacccctcccggtgttgttattaaacgtctgtggagcttctgctgcaaggaacaaaaaagaaaaaaatcaaaaaagcgacaaaaaaacacaaacagaagaggaaaaaaaagcaacaaaaaaagaaaacacacagaagagatttaaaaaaaaaaaaggaaaaaaaaaaaagacataaactggcaccagttaactttcttgtacttttttgctgaatttagcttcttgtagttttaacttattgctatgttaactatttattctcctcgttgccctgtaaggacatccgtgtatatttctgttacttcatccggtttgcaagttaaaggaacgacaatgttctctttgtttctttaagttttgccgagacatggttatgcctaatttatttataaaaggggaagtggaatcattaaagtaataataattattaataacagtaatggtagccgagtggcacgcgggggcgtgtgctctgcgggacagtccccacggccagcgacgtccaggtcaccaatgggattctttttgctcttgtcttgagaattttttcagtcctatttagctggtgaaatccctagcttgttcttgatacacgaacctatttattctcgtggttttaagtcctccctgccctctctcctctcccctgcagcagggcagggacccctctcccctgctgtctcttggggctctctcccctccgccctctgcattcgggaacacgcacgtccgcgtgggaagcttgcagcagggcgtccgagcaataagggctgggtttgtcccccaccctggggggggccaggctccagagagggggcacctccccacacaccccccccccaccgaggcctaggcccctgccacccccaagactgggaggggacttctttttctaaaacacaaaactcagcccagccaggccccctccctggaggccagcccctccccgcagggggccaggccggggctcccaggcgagggggacttggggcttccacgtccctggggggcaggggccaggccaggggggagggggctcagcccctccacccctcccttcatcctgttatttattcggaaggtttcaaatcacgacagagtccatgttggaggtgataaaaaactgtaaaaaaaaaaaaaaaaaaaaagacaaaacaaaagacaaaaaaaaaaaaaaaacccaacaagaacacttcgcgttgcgtttagactatttattaccgggatcacaggcctggccgcggtaacagacttttacatggaattgtttaattatttgtacttttcatgccagaaaataaaagttcagaatctt

SEQ ID NO: 9395 - DNA, 4661 bp, Homo sapiens
ggacttgaacacacgggaccggacaggaccgaccgaggggcggcggcgaaaggcagagcgccgcgatctctgtcgggaagcgcaacctccccgggccccgcggggccgcgcagggggcgtcctcaaccccgcgcccgctccctctttccatcccctgccgcccgcaggccaccccggggcccggccatccgcgcgcgcatccccgggttcgggcccgtccctggccctcgagggagccgccgccttcatcgccacatctgcagcggccgcaccagaggccgcccgggcgggaccccagcgtgagcatcgggcgcccccctaggagtgcaccacccccggagcccccctcaacacggaccgcgcccgccgggcacacaagaatggtcactcagatactgggggccatggagtctcaggtgggggggggcccggccggcccggccctgcccaacgggccactccttggtacaaatggagccactgacgacagcaagaccaacctcatcgtcaactacctgccccagaacatgacccaggatgagttcaagagtctcttcggcagcattggcgacatcgagtcctgcaagttggttcgggacaagatcacagggcagagccttggctacgggtttgtgaactattctgaccccaatgatgcagacaaagccatcaacaccctcaacggcctcaaattacagacgaagaccatcaaggtgtcctatgccagacccagttcagcatccatccgggatgctaacctgtacgtcagcgggctccccaagaccatgagccagaaagagatggagcagctcttctcccagtacggccgcatcatcacgtcccgcatcctggtggaccaggtcacaggtgtctctcggggtgtgggattcatccgctttgacaagaggattgaggccgaagaggctatcaaaggactgaatgggcagaagccgctgggcgcagctgagcccatcacagtcaagttcgcgaacaacccaagtcagaagacggggcaggcgctgctcacccacctctaccagtcatccgcccggcgctacgcaggccccctacaccatcagacccagcgtttccggctggacaatttgctcaacatggcctacggcgtcaagaggttctcgccgatcgccatcgatggtatgagcggcctggcgggcgtgggcctgtcggggggcgcggcgggcgccggctggtgcatcttcgtgtacaacctgtcaccggaggcagacgagagcgtgctgtggcagctgttcgggccttttggggcagtcaccaacgtcaaggtcatccgtgatttcaccaccaacaagtgcaagggtttcggcttcgtgaccatgaccaactatgacgaggcggccatggccatcgccagcctgaacggctatcgcctgggcgagcgcgtgctgcaggtctccttcaagaccagcaaacagcacaaggcgtgagcccaccccgcctgccctcccaccccctccccgggcagcagagagagagagagagaaagagagagagagagagagaaggggcccaagagagacagcacaggcagccccacggacgacgcgagggccccacgtccctgcggaagccacagggtgagcactctggggtgggagggtctgcagggaattgggggggtgcccggggatcccccgccccatcctcctgcccccaccccaggctgggctgttcactctctcgtcttggtttggttcatggtgaaggtttttgtttcttttttcggctaaaaagaatgcagagatgtgcccccacccccaccctcgaccacccccgatgggatggcttggggggctccagggggtgccctcccagacccccttgcccaggcctccccagcacctaggtggggcctggggtaggaggaacaggtttaaaaatccccaaaaaagcgaaccgtgaggaggggtgtgggcacccccggcccagtgccccctggtggaatgcgggggagcaggcagtggggctggaagcagaaacaaaatgaaaaaaaaaggggggtgggaggggaagaaaaactctatttttgtaaaaagggaaaaagacctcgtggagaatttttactggggattcttgaacttgaaaaaaaaaaacacaaaaaaagacaaaaaaaaaaaaagaaaatattttggcaggttatgtttaccaactggggcgggggtggggggggcccagggagcagggcttaggggctagcagcccacggggccacacagagaaacaaccacgcagacagtcacaccacggggacacacggacagacgcagacggacacagcgacatgccccagacacgttaagggactggttggccaaactcagacacgtggacagggatagacagaaagagacagaagctggggctacgtccatgtggacacagaccacagatgtgggcacacgaatccatccacctgtccacgtgcacacgtgaatgtagcgatagatatttggacatcaaatttggacaccaggtcacggagaaacacaaacaccacccaggaacacgcagacatatgcccatagcatcccacaggcccaggcaggaggtcccaccccagaccctgccccagacgctccctcaccctctcggccccctcgccctggcccccaggttctctgcagagatctctcctggacccccagcggtctccttggcgcccacgaacacaggcgtgcacacgcagcgcacatgcattgagacacacgatacctcgttccaccttggcgtcacggtgggctggaggcagcccccccccccacaacacttgaggccaaaggacacccctgtccccggggctcagcctccccctgggccgaggccttggcccacacagctgagggagaggcccagccctgagcctcccccaccaggactgggcctccccggcagcaagaccccggcactccccgccaggcccagggtggggtggatgggcccaaaggcccagccccacactcctttcccgtccacttgtcacctacctatcccctttcggtttgttgggtttttcgtctttccagattgcagtggacacagcccccgatctcgagccccggcccccggcttctgtctggacattgcatcgccctagttttctttctttaaaaaaaaaaaattccaacagaagccacaggccggagcccctgggagccctcgcaccgctccccaccccactcagcggccccatcggaactgagaattgcaaaacccccgactttagctatagttaagttgccttcccccggtgtccccacgtttggtgtctggctatggcgcccccatctgactgtccagctctctctcccccacccctcccggtgttgttattaaacgtctgtggagcttctgctgcaaggaacaaaaaagaaaaaaatcaaaaaagcgacaaaaaaacacaaacagaagaggaaaaaaaagcaacaaaaaaagaaaacacacagaagagatttaaaaaaaaaaaaggaaaaaaaaaaaagacataaactggcaccagttaactttcttgtacttttttgctgaatttagcttcttgtagttttaacttattgctatgttaactatttattctcctcgttgccctgtaaggacatccgtgtatatttctgttacttcatccggtttgcaagttaaaggaacgacaatgttctctttgtttctttaagttttgccgagacatggttatgcctaatttatttataaaaggggaagtggaatcattaaagtaataataattattaataacagtaatggtagccgagtggcacgcgggggcgtgtgctctgcgggacagtccccacggccagcgacgtccaggtcaccaatgggattctttttgctcttgtcttgagaattttttcagtcctatttagctggtgaaatccctagcttgttcttgatacacgaacctatttattctcgtggttttaagtcctccctgccctctctcctctcccctgcagcagggcagggacccctctcccctgctgtctcttggggctctctcccctccgccctctgcattcgggaacacgcacgtccgcgtgggaagcttgcagcagggcgtccgagcaataagggctgggtttgtcccccaccctggggggggccaggctccagagagggggcacctccccacacaccccccccccaccgaggcctaggcccctgccacccccaagactgggaggggacttctttttctaaaacacaaaactcagcccagccaggccccctccctggaggccagcccctccccgcagggggccaggccggggctcccaggcgagggggacttggggcttccacgtccctggggggcaggggccaggccaggggggagggggctcagcccctccacccctcccttcatcctgttatttattcggaaggtttcaaatcacgacagagtccatgttggaggtgataaaaaactgtaaaaaaaaaaaaaaaaaaaaagacaaaacaaaagacaaaaaaaaaaaaaaaacccaacaagaacacttcgcgttgcgtttagactatttattaccgggatcacaggcctggccgcggtaacagacttttacatggaattgtttaattatttgtacttttcatgccagaaaataaaagttcagaatctt

SEQ ID NO: 9396 - DNA, 1415 bp, Homo sapiens
caacctttgggatgtgtgcatggtggcaaggggctgactgatatgagattacttcttttaagggaaattgtcattaatgagtcaagaaactgctcatttatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggctggacaatttgcttaatatggcctatggcgtaaagaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaa

SEQ ID NO: 9397 - DNA, 2467 bp, Homo sapiens
aaagagagtgatttatttgggcttcagtaaatgctgcatcttgtatttcaaagagtttcctgtcatgacctcataaaaaagaggaggcggcttgtatgtgtagcagtgcctggcgtgttgagttgttgcttccttctctgggcagcagctctgtaagaaggaatgtcagcttttacataacgttcctttccgcttttgacacactgtgtgagggtccatcttcttctgatcacagatggagtggaatggcttgaagatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggctggacaatttgcttaatatggcctatggcgtaaagaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgccaaagaggtggtctctttgctgaaaatgggtttcaagaaaaatctatttttataaaatataaagaatttttacaagagaatctggatttgagaaaaaaatattttgactggctaatttaggggaaattgacaactttgtcgcgttcatactgcactggtaactttttagagatcaagatgtgtgttttaaactggattcgtagactgttttttgaaggatgggctataaacagatgatcttcatatcttttcatagcatgtaataataattaaaaaacaattattaattactaggggaaaggagtgttcgttctacccagggtaccacagttccccacagtcaaaacccaaaagcaaggagatgagttgaaagacagtttttctttaagtcatcagtatgggatgtcagcagaacaaaaattaaaaa

SEQ ID NO: 9398 - DNA, 3349 bp, Homo sapiens
taaacctcgagaggcagctcctggatactgaacactgagatgggcagttgtgtttcgggggactgcgcagtcaaaacggcaaagagagtgatttatttgggcttcagtaaatgctgcatcttgtatttcaaagagtttcctgtcatgacctcataaaaaagaggaggcggcttgtatgtgtagcagtgcctggcgtgttgagttgttgcttccttctctgggcagcagctctgtaagaaggaatgtcagcttttacataacgttcctttccgcttttgacacactgtgtgagggtccatcttcttctgatcacagatggagtggaatggcttgaagatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggctggacaatttgcttaatatggcctatggcgtaaagagactgatgtctggaccagtccccccttctgcttgtccccccaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgccaaagaggtggtctctttgctgaaaatgggtttcaagaaaaatctatttttataaaatataaagaatttttacaagagaatctggatttgagaaaaaaatattttgactggctaatttaggggaaattgacaactttgtcgcgttcatactgcactggtaactttttagagatcaagatgtgtgttttaaactggattcgtagactgttttttgaaggatgggctataaacagatgatcttcatatcttttcatagcatgtaataataattaaaaaacaattattaattactaggggaaaggagtgttcgttctacccagggtaccacagttccccacagtcaaaacccaaaagcaaggagatgagttgaaagacagtttttctttaagtcatcagtatgggatgtcagcagaacaaaaattaaaaagattaattttccttttgatctaaaacttccttagtttgagcagtaggtgctacaaaattatttacatatcttagtatcatagttaaatgtaatgtgtttaggagaggaaaacaaaagatacatttgctttaaattcattaagaaattttcaaattcactttgtagcccatgctgatagaattgggctgtgttggtacatttgaaacactgtttatgttgcttgaaacacttatttatttaatcgccgatgtgatgatgcctatggccgagatcaaatatagctagattggctagactacttatttgtttacttaaactatgggaagaagcatattattgtgtcattctgttgtgtgtgtatgtgtatatacaatataaatatatatatataaagttattttttctttgggttaatttattataagttgtaacacttggctagttttgtttgtatatgtcttaaaatgttttcttatgatatttaagtgacagttaaagaggtatcaaggtaacttgtgtagaactattctttgatatattgtcatgtttgttgtgaatattttttcttactgcacagtagaaaaataaaaacaactgagtctttattttaatgtaactcagattggggaaaacaaaacagagctaagggaacaaaatgactgagggagcactctcccacgtccagtgcactgatcattttagtatgtttgtgctttgtacggttatatatttaaaacgaaaacaaaacaaaaaaatacaa

SEQ ID NO: 9399 - DNA, 1591 bp, Homo sapiens
tagaatcgggggtttcagctcactgctccttttcttttttttctttctctcccccgcccacccccccaaaaataattgatttgctttacaatcatccacactgtgttttgtggatctttaattatatataacaatagtagtcattttaaatatatattctgaaatctttgcaaattttaacagaagagtcgaagctctgcgagacccaatatttgccaataagaatggttatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggctggacaatttgcttaatatggcctatggcgtaaagagactgatgtctggaccagtccccccttctgcttgtccccccaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaa

SEQ ID NO: 9400 - DNA, 3966 bp, Homo sapiens
caaggctctgttcagttgttcttatctacatcctagaatcgggggtttcagctcactgctccttttcttttttttctttctctcccccgcccacccccccaaaaataattgatttgctttacaatcatccacactgtgttttgtggatctttaattatatataacaatagtagtcattttaaatatatattctgaaatctttgcaaattttaacagaagagtcgaagctctgcgagacccaatatttgccaataagaatggttatgataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggctggacaatttgcttaatatggcctatggcgtaaagaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgccaaagaggtggtctctttgctgaaaatgggtttcaagaaaaatctatttttataaaatataaagaatttttacaagagaatctggatttgagaaaaaaatattttgactggctaatttaggggaaattgacaactttgtcgcgttcatactgcactggtaactttttagagatcaagatgtgtgttttaaactggattcgtagactgttttttgaaggatgggctataaacagatgatcttcatatcttttcatagcatgtaataataattaaaaaacaattattaattactaggggaaaggagtgttcgttctacccagggtaccacagttccccacagtcaaaacccaaaagcaaggagatgagttgaaagacagtttttctttaagtcatcagtatgggatgtcagcagaacaaaaattaaaaagattaattttccttttgatctaaaacttccttagtttgagcagtaggtgctacaaaattatttacatatcttagtatcatagttaaatgtaatgtgtttaggagaggaaaacaaaagatacatttgctttaaattcattaagaaattttcaaattcactttgtagcccatgctgatagaattgggctgtgttggtacatttgaaacactgtttatgttgcttgaaacacttatttatttaatcgccgatgtgatgatgcctatggccgagatcaaatatagctagattggctagactacttatttgtttacttaaactatgggaagaagcatattattgtgtcattctgttgtgtgtgtatgtgtatatacaatataaatatatatatataaagttattttttctttgggttaatttattataagttgtaacacttggctagttttgtttgtatatgtcttaaaatgttttcttatgatatttaagtgacagttaaagaggtatcaaggtaacttgtgtagaactattctttgatatattgtcatgtttgttgtgaatattttttcttactgcacagtagaaaaataaaaacaactgagtctttattttaatgtaactcagattggggaaaacaaaacagagctaagggaacaaaatgactgagggagcactctcccacgtccagtgcactgatcattttagtatgtttgtgctttgtacggttatatatttaaaacgaaaacaaaacaaaaaaatacaagggttcatgctcttccctgggtaatagaaacagttactcgctatgcataatctagttgatagttaaatttgctattgcttttcttgtcttgttatataaaatcttttcaatacaagtttagtcttaatggtaataaaacgttatggttatttataacttgtgcttattttgtgcattttttcccatgctgaacccactaagtgcatgtagacaggactgttgttttcacactgaaaaggcaaactttgtagtagtcgttgtagtggtagacagataacgaataccaaggctgcatcatagactcctcctttaaattttttttctgtttttttttcctcttttcggttttggatataacaccagatttcagttcagagaacactcgttcaacattcagggaaagctttttacgtcacctgctatgaatgaacgtagtttgctggcaaagttttgatgcatttgctaagcattagtgggaaaggcatgccaaaatcttctctataatgtgttcaatcttgggggaaaaaaaaaggaaaaaaaatcttaggaccaggcagttgtatactttagttattaatgaatgacttcatgttaatcttgctagtttagatgatttccaagggaaagtattgtaaatgtttttttttcataatcttgttgtgtttgaattatttgtactttatctgtccagacaataaatgaaagtgtgtagaatggatttgacttcccaaa

SEQ ID NO: 9401 - DNA, 3775 bp, Homo sapiens
gtctgacttggagttttgtgctgttgcacgtgaatgctctggaactgccctaatcgactgaaaatgagccggctacagtcatatggaacagataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggctggacaatttgcttaatatggcctatggcgtaaagaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgccaaagaggtggtctctttgctgaaaatgggtttcaagaaaaatctatttttataaaatataaagaatttttacaagagaatctggatttgagaaaaaaatattttgactggctaatttaggggaaattgacaactttgtcgcgttcatactgcactggtaactttttagagatcaagatgtgtgttttaaactggattcgtagactgttttttgaaggatgggctataaacagatgatcttcatatcttttcatagcatgtaataataattaaaaaacaattattaattactaggggaaaggagtgttcgttctacccagggtaccacagttccccacagtcaaaacccaaaagcaaggagatgagttgaaagacagtttttctttaagtcatcagtatgggatgtcagcagaacaaaaattaaaaagattaattttccttttgatctaaaacttccttagtttgagcagtaggtgctacaaaattatttacatatcttagtatcatagttaaatgtaatgtgtttaggagaggaaaacaaaagatacatttgctttaaattcattaagaaattttcaaattcactttgtagcccatgctgatagaattgggctgtgttggtacatttgaaacactgtttatgttgcttgaaacacttatttatttaatcgccgatgtgatgatgcctatggccgagatcaaatatagctagattggctagactacttatttgtttacttaaactatgggaagaagcatattattgtgtcattctgttgtgtgtgtatgtgtatatacaatataaatatatatatataaagttattttttctttgggttaatttattataagttgtaacacttggctagttttgtttgtatatgtcttaaaatgttttcttatgatatttaagtgacagttaaagaggtatcaaggtaacttgtgtagaactattctttgatatattgtcatgtttgttgtgaatattttttcttactgcacagtagaaaaataaaaacaactgagtctttattttaatgtaactcagattggggaaaacaaaacagagctaagggaacaaaatgactgagggagcactctcccacgtccagtgcactgatcattttagtatgtttgtgctttgtacggttatatatttaaaacgaaaacaaaacaaaaaaatacaagggttcatgctcttccctgggtaatagaaacagttactcgctatgcataatctagttgatagttaaatttgctattgcttttcttgtcttgttatataaaatcttttcaatacaagtttagtcttaatggtaataaaacgttatggttatttataacttgtgcttattttgtgcattttttcccatgctgaacccactaagtgcatgtagacaggactgttgttttcacactgaaaaggcaaactttgtagtagtcgttgtagtggtagacagataacgaataccaaggctgcatcatagactcctcctttaaattttttttctgtttttttttcctcttttcggttttggatataacaccagatttcagttcagagaacactcgttcaacattcagggaaagctttttacgtcacctgctatgaatgaacgtagtttgctggcaaagttttgatgcatttgctaagcattagtgggaaaggcatgccaaaatcttctctataatgtgttcaatcttgggggaaaaaaaaaggaaaaaaaatcttaggaccaggcagttgtatactttagttattaatgaatgacttcatgttaatcttgctagtttagatgatttccaagggaaagtattgtaaatgtttttttttcataatcttgttgtgtttgaattatttgtactttatctgtccagacaataaatgaaagtgtgtagaatg

SEQ ID NO: 9402 - DNA, 1951 bp, Homo sapiens
aggtgggcagggggtggcggcggcgacggtggcggagccgcagagcgagctagagagcgagagcggtgagactctgcggacgtcttcccgcccgccgcgctccgccccacccagcctccgcagcctcgggccggatcgcccggcggggaagatgcgcctcaagaaccagataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggacagagtttagggtatggatttgttaactatattgatccaaaggatgcagagaaagccatcaacactttaaatggactcagactccagaccaaaaccataaaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtcccccaaccggcgctacccaggtccacttcaccaccaggctcagaggttcaggctggacaatttgcttaatatggcctatggcgtaaagaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaagaaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgcc

SEQ ID NO: 9403 - DNA, 1346 bp, Homo sapiens
ggcggaagcggagaccatgttccgagcggcggctccggggcagctccggcgggcggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaactttttaaattctgtactaaaatctataataaagcttttccacagctttaaaactatcagaaatatgcctagcctctagagaaaattgaagaaaaggagtaaaaattttgtttatttatttatttttttgcctttcttgttcatggagagctctatgttttaggaagattgtaaacatgattgtctccaccagcctaatcaacctactaatctcattgttgaagggcaaacttcataggagaaggtaactgaattggcaagtgcag

SEQ ID NO: 9404 - DNA, 2287 bp, Homo sapiens
attaggtgactggctgaggcggcgccagttggccgggcacggggctgctgtaaggccgaggttgcggcggaagcggagaccatgttccgagcggcggctccggggcagctccggcgggcggcctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtggcacaagatctctgtaaagtagcaggcatagcaaaagttctggtggctcagcatgatgtgtacaaaggcctacttccagaggaactgacaccattgattttggcaactcagaagcagttcaattacacacacatctgtgctggagcatctgccttcggaaagaaccttttgcccagagtagcagccaaacttgaggttgccccgatttctgacatcattgcaatcaagtcacctgacacatttgtgagaactatttatgcaggaaatgctctatgtacagtgaagtgtgatgagaaagtgaaagtgttttctgtccgtggaacatcctttgatgctgcagcaacaagtggcggtagtgccagttcagaaaaggcatcaagtacttcaccagtggaaatatcagagtggcttgaccagaaattaacaaaaagtgatcgaccagagctaacaggtgccaaagtggtggtatctggtggtcgaggcttgaagagtggagagaactttaagttgttatatgacttggcagatcaactacatgctgcagttggtgcttcccgtgctgctgttgatgctggctttgttcccaatgacatgcaagttggacagacgggaaaaatagtagcaccagaactttatattgctgttggaatatctggagccatccaacatttagctgggatgaaagacagcaagacaattgtggcaattaataaagacccagaagctccaattttccaagtggcagattatggaatagttgcagatttatttaaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaactttttaaattctgtactaaaatctataataaagcttttccacagctttaaaactatcagaaatatgcctagcctctagagaaaattgaagaaaaggagtaaaaattttgtttatttatttatttttttgcctttcttgttcatggagagctctatgttttaggaagattgtaaacatgattgtctccaccagcctaatcaacctactaatctcattgttgaagggcaaacttcataggagaaggtaactgaattggcaagtgcagagttaaaaaagcacggctataaagcatgaatattatcttaaacatactccagtcttcagaagaccatagctaatgtgacaaaagcagacctgacttaaacctgacccagctccatgtatttagttggcttaaggtaaatttcattttccgtttaattttaaggttttgtcagtttataggacttttgtctgtaaaggagggagagtggaggaggggctgctttgagacagcatggcctctgatgcaagcagatagtttgatgttattataaacattcaaaatcctgtgcagagaatgctctagcctttcttttgccttctgttggcttcttttgggctctcttaggaagcacccaggcctgtgtagtcacctctggcactctcattctgctgcccagggcacagctgaggtccaagagtgtcaccagggctgcagctggtgtggatgcaggcccaagagcagaggctggtgaggctttgaacaggcctgcaggaaggcgtgggtaggtaggtgagtagaacaaagagggctgccctcctgaatcagatctgcagaagtaggagtagtgacctggatcaagcagacagtagggaagagaagggaagtgataagtgatggaggtggctagagtgcctttgtgtgaccagcctggggcccttccccagctgactagtgaaccctttctgatttgtgtcacaatcagttgctataaaacacttttaaaagttg

SEQ ID NO: 9405 - DNA, 915 bp, Homo sapiens
gcagagaggggcgcggggggcgggggtggtggggcttctggactgagccgctgagggtgcgggctgaccctgtaagtggctgcggcgggaagatggcggagctgcgcgtgctcgtagctgtcaagagggtcatcgactacgccgtgaagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtgctgctgggcaaacaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttgagcccctcccagagatggcaataaaactgactctcaacatctatctctgttaactt

SEQ ID NO: 9406 - DNA, 1300 bp, Homo sapiens
aaagaacaaaaggcttctgtgctgggcagcttgagttttccccaggctgctctattgttgcctgtagctgtgatttttcaggcaggctgctcctctgaggaccacccttaactgtctacctaactggtttttccttttcttctcctcatttgtatttatgtatcagtgtattatgtatttatatacacttggagatacagtaaaatgtacctctcactgtgggttaccataaatactgtaaatttgagaaacactctttcaggcctgagaggagcagtgacaacagtagggatgatcaagtcagatgtccctggtacccaggaatggctggatgagagaaggagacagggtgacctgcccctgcctacaaactctaacccagttctgtccctggagctgtgtgaccccggacaaggccctgcccctttccaggctgtcgttgtcctcatccagcctgggagagggttggcgctgaggcccccaccttcttgcctgtttcctcctgaccccaccccttcccctcctgctgggcagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtgctgctgggcaaacaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttgagcccctcccagagatggcaataaaactgactctcaacatctatctctgttaactt

SEQ ID NO: 9407 - DNA, 1903 bp, Homo sapiens
agagttcttgctttccggcaggtgatggcgccccccgcggcctagaggtccagcgcccgccgcgagcagcggacagtcctcctgttgtgtccgaccgagagtcctggtgactttgaacatgctggtgccgctagccaagctgtcctgcctgggagtgaacatggaaaggtttgcagaagaagcagatgttgtaatagttggtgcaggccctgcagggctctctgcagctgttcgtctaaaacagttggctgtggcacatgaaaaggacatccgtgtgtgtctagtggagaaagctgcccagataggagctcatactctctcaggggcttgccttgatccaggtgcttttaaagaactcttcccagactggaaagagaagggggctccacttaacactcctgtaacagaagacagatttggaattttaacagagaaatacagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatcagaatccatacctgagtccatttagagagttccaaaggtggaaacaccatcctagcattcggccaaccttggaaggtggaaaaaggattgcatacggagccagagctctcaatgaaggtggctttcagtctataccaaaactcacctttcctggtggtttactaattggttgtagtcctggttttatgaatgttcccaagatcaaaggtactcacacagcaatgaaaagtggaattttagcagcagaatctatttttaatcaactaactagtgaaaatctccaatcaaagacaataggactccatgtaactgaatatgaggacaatttgaagaactcatgggtatggaaagagctatattctgttagaaatataagaccgtcctgccacggagtactgggtgtatatggagggatgatttacactggaatcttttactggatattgagaggaatggagccgtggactctgaaacataaaggttctgactttgaacggctcaagccagccaaggattgcacacctattgagtatccaaaacccgatggacagatcagttttgacctcttgtcatctgtggctctgagtggtactaatcatgaacatgaccagccggcacacttaaccttaagggatgacagtatacctgtaaatagaaatctgtcgatatatgatgggcccgagcagcgattctgtcctgcaggagtttatgaatttgtacctgtggaacaaggtgatggatttcggttacagataaatgctcagaactgtgtacattgtaaaacatgtgatattaaagatccaagtcagaatattaactgggtggtacctgaaggtggaggaggacctgcttacaatggaatgtaaactgcagctagccagtttctttcaagtatggcaagctaacgttaaaatgtttagagattaacagatttcaga

SEQ ID NO: 9408 - DNA, 3282 bp, Homo sapiens
gtgctgtgggattcgcggacccctctggccgcgctgtggctgtttcaccgctccccggctgggacttggagtcccttatctttccctggtttggtacatgacccggaagcctcggctggccgttgcgtcatccatggcgccggcgcagagcgagaaggaggtgggaacgccgtgaagcaagagcggtcggcagagcggggaggcgaactgcagcagagttcttgctttccggcaggtgatggcgccccccgcggcctagaggtccagcgcccgccgcgagcagcggacagtcctcctgttgtgtccgaccgagagtcctggtgactttgaacatgctggtgccgctagccaagctgtcctgcctggcatatcagtgctttcatgccttaaaaattaagaaaaattatctacctctatgtgctacaagatggtcttcaacttctactgtgcctcgaattactacccattatactatttatccccgggataaggacaagagatgggaaggagtgaacatggaaaggtttgcagaagaagcagatgttgtaatagttggtgcaggccctgcagggctctctgcagctgttcgtctaaaacagttggctgtggcacatgaaaaggacatccgtgtgtgtctagtggagaaagctgcccagataggagctcatactctctcaggggcttgccttgatccaggtgcttttaaagaactcttcccagactggaaagagaagggggctccacttaacactcctgtaacagaagacagatttggaattttaacagagaaatacagaattcctgtgccaattcttccagggcttccaatgaataatcatggcaattacattgtacgcttgggacatttagtgagctggatgggcgaacaagcagaagcccttggtgttgaagtataccctggttatgcagctgctgaggtcctttttcatgatgatggtagtgtaaaaggaattgccactaacgatgtagggatacaaaaggatggtgcaccaaaggcaacatttgagagaggactggaactacatgctaaagtcacaatttttgcagaaggttgccatggacatctagccaagcaactatataagaagtttgatttgagagcaaattgtgaacctcaaacctacgggattggactgaaggagttatgggttattgatgaaaagaactggaaacctgggagagtagatcacactgttggttggcccttggacagacatacctatggaggatctttcctctatcatttgaatgaaggtgaacccctagtagctcttggtcttgtggttggtctagactatcagaatccatacctgagtccatttagagagttccaaaggtggaaacaccatcctagcattcggccaaccttggaaggtggaaaaaggattgcatacggagccagagctctcaatgaaggtggctttcagtctataccaaaactcacctttcctggtggtttactaattggttgtagtcctggttttatgaatgttcccaagatcaaaggtactcacacagcaatgaaaagtggaattttagcagcagaatctatttttaatcaactaactagtgaaaatctccaatcaaagacaataggactccatgtaactgaatatgaggacaatttgaagaactcatgggtatggaaagagctatattctgttagaaatataagaccgtcctgccacggagtactgggtgtatatggagggatgatttacactggaatcttttactggatattgagaggaatggagccgtggactctgaaacataaaggttctgactttgaacggctcaagccagccaaggattgcacacctattgagtatccaaaacccgatggacagatcagttttgacctcttgtcatctgtggctctgagtggtactaatcatgaacatgaccagccggcacacttaaccttaagggatgacagtatacctgtaaatagaaatctgtcgatatatgatgggcccgagcagcgattctgtcctgcaggagtttatgaatttgtacctgtggaacaaggtgatggatttcggttacagataaatgctcagaactgtgtacattgtaaaacatgtgatattaaagatccaagtcagaatattaactgggtggtacctgaaggtggaggaggacctgcttacaatggaatgtaaactgcagctagccagtttctttcaagtatggcaagctaacgttaaaatgtttagagattaacagatttcagaatgtctttctgcatattactgaacagaatagtcacaaaatgattatcaaataaaaattttatactatatgtaagattgtcccataaagaaattacgggtattgcttttaaataacctttataagaatgcagcatcttcctacctcttcagttcttcagagattcagtaccaagagcaaaattcactactggactttacatttgacttgccaaagttaagtaatcaaatataaaaatgaatatatattctagactaaagttttattgaaacacagccatacccattggttacacattgtctatggctaattttgaattacaactgtgcaggtgagtgggtgtgacattacatggtctacaaagcctaaaaactttatgatctggcccttgcagaagaagtatgcccatccctgaacaagtttgtgtgtgtgtgtgtgtgtgtgtgtgtgtgtgtgtgtgtattatctataagtatgaaaacctagcatcatccaccatggatacatcaaagaatcgaaggaaacaatatacaaacttaagctctcatctctttattcaataagatgtgtctttacaagtttaaaaagactggacaccattattttttatgaataatgcacataaccattttaaaaaacattttacttggccgggcacggtggctcacacctgtaatcccagcactttgggaggccaaggcggggtggatcacaaggtcaggagttcaagaccaacgtgacgtgaccaatatggtgaaaccccatctctactaaaaatacaaaaattagctgggcgtggtggcacgtgcctgtaatcccagctacttgggaagctgaggcaggagaattgcttgaacccgggaggcagaggatgcagtgagccgagattgcgccaccgcactccagcctgggtgacagagcaagactccatctcaaagaaacaaacaaaaccactttacttactgtattgtgacatgtttattaagcatgaacccctatcagtactcctaaactgtaaacagtaag

SEQ ID NO: 9409 - DNA, 2258 bp, Homo sapiens
gagctgtagggaaacgcaggggcggcttctaggtgctgccgccgccaccgccaccaccacctccaccgccgcctcggaacccaggcctggggggcggtggggccgcgtatggagcccccgccccccggagctgccaacattgccaacgccaccgccacgctacacacagcctcaactttcaggagacccgtccgtggccttatttattccacccttcctgtacatcgtagcgaatcaatccgtggcgccgcactcctccgcatccctctttaacagtacccctgggatggcgtgagcactcccccagcgatggacccatctgtgacgctgtggcagtttctgctgcagctgctgagagagcaaggcaatggccacatcatctcctggacttcacgggatggtggtgaattcaagctggtggatgcagaggaggtggcccggctgtgggggctacgcaagaacaagaccaacatgaattacgacaagctcagccgggccttgcggtactactatgacaagaacatcatccgcaaggtgagcggccagaagttcgtctacaagtttgtgtcctaccctgaggtcgcagggtgctccactgaggactgcccgccccagccagaggtgtctgttacctccaccatgccaaatgtggcccctgctgctatacatgccgccccaggggacactgtctctggaaagccaggcacacccaagggtgcaggaatggcaggcccaggcggtttggcacgcagcagccggaacgagtacatgcgctcgggcctctattccaccttcaccatccagtctctgcagccgcagccaccccctcatcctcggcctgctgtggtgctccccagtgcagctcctgcaggggcagcagcgcccccctcggggagcaggagcaccagtccaagccccttggaggcctgtctggaggctgaagaggccggcttgcctctgcaggtcatcctgaccccgcccgaggccccaaacctgaaatcggaagagcttaatgtggagccgggtttgggccgggctttgcccccagaagtgaaagtagaagggcccaaggaagagttggaagttgcgggggagagagggtttgtgccagaaaccaccaaggccgagccagaagtccctccacaggagggcgtgccagcccggctgcccgcggttgttatggacaccgcagggcaggcgggcggccatgcggcttccagccctgagatctcccagccgcagaagggccggaagccccgggacctagagcttccactcagcccgagcctgctaggtgggccgggacccgaacggaccccaggatcgggaagtggctccggcctccaggctccggggccggcgctgaccccatccctgcttcctacgcatacattgaccccggtgctgctgacacccagctcgctgcctcctagcattcacttctggagcaccctgagtcccattgcgccccgtagcccggccaagctctccttccagtttccatccagtggcagcgcccaggtgcacatcccttctatcagcgtggatggcctctcgacccccgtggtgctctccccagggccccagaagccatgactactaccaccaccaccaccaccccttctggggtcactccatccatgctctctccagccagccatctcaaggagaaacatagttcaactgaaagactcatgctctgattgtggtggggtggggatccttgggaagaattactcccaagagtaactctcattatctcctccacagaaaacacacagcttccacaacttctctgttttctgtcagtcccccagtggccgcccttacacgtctcctacttcaatggtaggggcggtttatttatttattttttgaaggccactgggaggagcctgacctaaccttttagggtggttaggacatctcccccacctccccacttttttccccaagacaagacaatcgaggtctggcttgagaacgacctttctttctttatttctcagcctgcccttggggagatgagggagccctgtctgcgtttttggatgtgagtagaagagttagtttgttttgttttattattcctggccatactcaggggtccaggaagaatttgtaccatttaatgggttgggagtcttggccaaggaagaatcacacccttggaatagaaatttccacctccccaacctttctctcagacagcttatccttttcaaccaactttttggccagggaggaatgtccctttt

SEQ ID NO: 9410 - DNA, 4205 bp, Homo sapiens
tgggcggccagccccggcgcacagccgcggccggggcgcgcggcgcggggcggaaaagcctgtttacacagactgcacaccgcctggggaataatgcagtaaaggaagtgagccggctcggcctgactgctccaacttcctgctctcacacacaccagaggggaaaaaaaaagaggagcgagagaaagaaaaaaagggggaaaaatcaggatctcattacaagagccacagaccgtctgcagacgcctgtcagcatggaaagtcgggggctttcgcccgggtcctcctagaaattccccccgaagaagactcccccacatctgggtatggagagtgcaatcacgctgtggcagttcctgttgcagttgctgctggatcagaaacatgagcatttgatctgctggacctcgaacgatggtgaattcaagctcctcaaagcagaagaagtggccaagctgtggggactccgaaaaaacaaaacaaatatgaactatgataagctgagcagagccctgcgatactattatgacaagaacatcatcaagaaggtgatcgggcagaagtttgtgtacaagtttgtctctttcccggagatcctgaagatggatcctcacgcggtggagatcagccgggagagccttctgctgcaggacagcgactgcaaggcgtctccggagggccgcgaggcccacaaacacggcctggccgccctcagaagcacgagccgcaacgaatacatccactcaggcctgtactcgtccttcaccattaattccctgcagaacccaccagacgccttcaaggccatcaagacggagaagctggaggagccgcccgaagacagcccccccgtggaagaagtcaggactgtgatcaggtttgtgaccaataaaaccgacaagcacgtcaccaggccggtggtgtccctgccttccacgtcagaggctgcggcggcgtccgccttcctggcctcgtccgtctcggccaagatctcctctttaatgttgccaaacgctgccagtatttcatccgcctcacccttctcatctcggtccccgtccctgtcccccaactcacccctcccttctgaacacagaagcctcttcctggaggccgcctgccatgactccgattccctggagcccttgaacctgtcatcgggctccaagaccaagtctccatctcttcccccaaaggccaaaaaacccaaaggcttggaaatctcagcgcccccgctggtgctctccggcaccgacatcggctccatcgccctcaacagcccagccctcccctcgggatccctcaccccagccttcttcaccgcacagacaccaaatggattgcttctgactccgagtccactgctctccagcatacatttctggagcagccttagtccagttgctccgctgagtcctgccaggctgcaagggccaagcacgctgttccagttccccacactgcttaatggccacatgccagtgccaatccccagtctggacagagctgcttctccagtactgctttcttcaaactctcagaaatcctgatgacgtctggccacaattaaggactcattaactgatgaaacaaatttgtccccacgggctagtttacctgtgtcgtgagaaggacattgtgaaactcttgttaatttggtttgcacttttcataacatggatagtctagatttatgttagcattttaaaaactgtttttgatatattcaagtatatatgaaaatctgtttggcattaagtgaattttaatgtttttgtttttatatccttttagctcttaagtgttgaacactgttgacagtgaagaacttttcttaatggttttcagtataactaataaggatgtgaagcttttttctctttagttctgagtatgctaaactgtgtgcttatatagactataaccagttgtgccttccttcgcatttaatgtaaatgaatgatttatatattttttagtattaagaggaaatgtttgaaagatgaaaattagtatcaaacagctctctagtagaatttcattatttttcaccagtgggcaatatgaaagcatatatcacgttttgttttactttcaattgtataagaattgccttagaacctcttttgaactgaaattcagtaaatgtccaagtaatgtttttataataaactaagccatatttagacaataaacattgataaaagaaaatgttctaaagtacattttcaaaagaatggaccttgaaaggctagcctccttagctgtttacagtatcttatcttttagatgcctcccagacaaaaatctgagatggaaaagctacatcaagttcatgctattccaggcccaagaatatctcctaggttagcatattcttatttcaaaaaattagccctggttttctcagttttccatagggaatcccgaccatctgatatatttactgtgtcagtataagtaagttggggttcccctggaactataattaacatttaaaaaatctaatgctttagaagaagctcacagagtggtgatgaacccaaacaacaaagaaaccatttttaacactaggtatcttcatcagtataggtaggtgttcacaatttttgatggatcaaaaacttgctgtaatacaaatagagagtggaggtactaaaggccttgcttgtggaaactgagagaggatacactgctttatgtattactaaagttaggggagaatgaaggaaatctgacagatgaaaaattctacaggaacctcatcatcgtggaactgaactgatgataacttggaacactccagtaaattctgttgtgtaatgtaatttggagcagtgataatacagacatattttctgttccatcagaaaatcagcaggcaccagtccaaaggtaccacacctgtacatgaagaaggaaagttctaatacaagaaaactgaaaagcaccaagctttaaattcaagattaattacaatccttaactataagtgatgataaaaactaacttgaaatgtgactaaataactgatccaaactgggcattaagtggcaggattatgagaaaggataaaaaaagagatttgagaaaacacatttcttgaattttcagaaaaaaatctagactattgctttgacacttagaaattctgaggtttttcaattggaattgagcatctctgtatgtggggatgtgggcccttatcaagggataaaaatccaaacactctaacatgcctccttgactgtaaagtaatgacactggttccaaaattcacaaataatagacactactgtccccccacccccaccccataggctaagaataattctgtaccagaataaaaggagctggtccagggaactgatatttactgaacatacaaagttagtgctagaaggggcctttgagaatgcttcccgccacctgtttccagctcaagacaggtgcacagcagaagctgggagttgcctatggctgcacagctcactgaaggtagaacaatgattggtgctcagtccaattctgtctcccccatgcctagctgttaagtaattactggttcaaaactacgtgttattagtaaaacaaacaaaacagataaagacagcatttaaaactgtgttgtcagataagagaacacatccaaaatgcatgattcttacaaactaaaggaagttaatgtgcaaaaatctcaaccaaaactactatttttagtatacttgtttacgtaaatgctgattggaaatatttaaatgactatagatctgattctttcttttcctttggaaactgggattaatgtatgctctagatccatttattagaaatgcaaaaatactacaattttttgatggatgaaaatactcctgtaacacaaacagagaactggaggaactgaagaataactcactcatatagctctgcctcattctgtgtgtgtgtgcatgtgtgtgttagcagaggtattttactcagaaaataggtttcaaagaacattaatgactttcttttcccttttatgtctgcttaatcagtgttaaactgctatgggaaaagttttatagaactatataacctgaatgttggtctctttgtacacatcttttctatgactgcaaatcttcactttatgtatcatttttactgtcatattatttttgttcaataaaaactttgtgataaaaggtgtttagaggtaa

SEQ ID NO: 9411 - DNA, 539 bp, Homo sapiens
acagccgcggccggggcgcgcggcgcggggcggaaaagcctgtttacacagactgcacaccgcctggggaataatgcagtaaaggaagtgagccggctcggcctgactgctccaacttcctgctctcacacacaccagaggggaaaaaaaaagaggagcgagagaaagaaaaaaagggggaaaaatcaggatctcattacaagagccacagaccgtctgcagacgcctgtcagcatggaaagtcgggggctttcgcccgggtcctcctagaaattccccccgaagaagactcccccacatctggaagaccagtatggtgctgtgaaatgttgcaaaacatgacctgatgacaacccaaaacacttcatagaaaactatccaagaatgtgacttcctggagtagagtcttttttcactgagggtatggagagtgcaatcacgctgtggcagttcctgttgcagttgctgctggatcagaaacatgagcatttgatctgctggacctcgaacgatggtgaattcaagctcctcaaagcaga

SEQ ID NO: 9412 - DNA, 808 bp, Homo sapiens
ccgtctgcagacgcctgtcagcatggaaagtcgggggctttcgcccgggtcctcctagaaattccccccgaagaagactcccccacatctggaagagattaaatgaagatgtgtgtgtgttgaagactgcatagtgcacactctgtgtggctaccggtgagccacgtggcgggatacaggactcaaagaagatcacactggagaagggagttcatgctctgttgcccaggctggggtgcagtgatgtgatcacagctcactgcagcctcaaactcctgggcttaagtgatcctcctgcctcagctccccaagtagctgggactacaggtatggagagtgcaatcacgctgtggcagttcctgttgcagttgctgctggatcagaaacatgagcatttgatctgctggacctcgaacgatggtgaattcaagctcctcaaagcagaagaagtggccaagctgtggggactccgaaaaaacaaaacaaatatgaactatgataagctgagcagagccctgcgatactattatgacaagaacatcatcaagaaggtgatcgggcagaagtttgtgtacaagtttgtctctttcccggagatcctgaagatggatcctcacgcggtggagatcagccgggagagccttctgctgcaggacagcgactgcaaggcgtctccggagggccgcgaggcccacaaacacggcctggccgccctcagaagcacgagccgcaacgaatacatccactcaggcctgtactcgtccttcaccattaattccctgcagaacccaccagacgccttcaaggc

SEQ ID NO: 9413 - DNA, 2118 bp, Homo sapiens
gcggccgcggagggcctggcaggccccgccgctgcaaggaacgccccgaacgcgcgcgcccggcgtgtagcggccccaagacccgcgccgccgctgccgcgtgcgggggcggggagggcggggcgccaggagccgcggcggcgggagatgcgggcggctgcgggcacccggcgggctcggcttggccgccgccgccttctacggctccgccgcgggggtcgcagcggctgccgcgccgtcctcgagtttccagcgtgaggaggaggctgagggcggagaggcgcatcgtgttcgaggcggagaccgagggggagccccgcgcgcggcgtcgctcattgctatggacagtgctatcaccctgtggcagttccttcttcagctcctgcagaagcctcagaacaagcacatgatctgttggacctctaatgatgggcagtttaagcttttgcaggcagaagaggtggctcgtctctgggggattcgcaagaacaagcctaacatgaattatgacaaactcagccgagccctcagatactattatgtaaagaatatcatcaaaaaagtgaatggtcagaagtttgtgtacaagtttgtctcttatccagagattttgaacatggatccaatgacagtgggcaggattgagggtgactgtgaaagtttaaacttcagtgaagtcagcagcagttccaaagatgtggagaatggagggaaagataaaccacctcagcctggtgccaagacctctagccgcaatgactacatacactctggcttatattcttcatttactctcaactctttgaactcctccaatgtaaagcttttcaaattgataaagactgagaatccagccgagaaactggcagagaaaaaatctcctcaggagcccacaccatctgtcatcaaatttgtcacgacaccttccaaaaagccaccggttgaacctgttgctgccaccatttcaattggcccaagtatttctccatcttcagaagaaactatccaagctttggagacattggtttccccaaaactgccttccctggaagccccaacctctgcctctaacgtaatgactgcttttgccaccacaccacccatttcgtccataccccctttgcaggaacctcccagaacaccttcaccaccactgagttctcacccagacatcgacacagacattgattcagtggcttctcagccaatggaacttccagagaatttgtcactggagcctaaagaccaggattcagtcttgctagaaaaggacaaagtaaataattcatcaagatccaagaaacccaaagggttagaactggcacccacccttgtgatcacgagcagtgatccaagcccactgggaatactgagcccatctctccctacagcttctcttacaccagcatttttttcacaggtagcttgctcgctctttatggtgtcaccattgctttcatttatttgcccttttaagcaaatccagaatttatacactcaagtttgctttctgttacttaggtttgtcttagaaaggttatgtgtgactgtcatgtgaaagttaccccatttctcatcttaattaggattgctaaaatagaaagtttggagtattttcttaaaaaattcattgttctacaagtaaataaatattttgatttttctatttcctcctaaagaaagtacacacactctctcgctctctctcggtcttataaaactcgttggtgtcttataaaacaaacagtgataatctcaagttagaaaacagtaggtcctgagaaccataagaaaaatgactggtgtgatgttgagtaacaagttggtacagttactttagctatttattaacttgctcatctcatagaacattttagtagatttttcacacacctcattattaaaaaaaaacaaacatgctggtgtcttggttacccattattcctctgtacctgaattcaggttggtttttctatttggaaaagactttataaatgttggcttaaaaagaggttgagcaccagaatctcagaatttaccaccaaagaactcatccatgtaaccaaaaaccacttgtacccccaaaaactattgaaataaaaatttaaaaaattttaa

SEQ ID NO: 9414 - DNA, 10239 bp, Homo sapiens
gcggccgcggagggcctggcaggccccgccgctgcaaggaacgccccgaacgcgcgcgcccggcgtgtagcggccccaagacccgcgccgccgctgccgcgtgcgggggcggggagggcggggcgccaggagccgcggcggcgggagatgcgggcggctgcgggcacccggcgggctcggcttggccgccgccgccttctacggctccgccgcgggggtcgcagcggctgccgcgccgtcctcgagtttccagcgtgaggaggaggctgagggcggagaggcgcatcgtgttcgaggcggagaccgagggggagccccgcgcgcggcgtcgctcattgctatggacagtgctatcaccctgtggcagttccttcttcagctcctgcagaagcctcagaacaagcacatgatctgttggacctctaatgatgggcagtttaagcttttgcaggcagaagaggtggctcgtctctgggggattcgcaagaacaagcctaacatgaattatgacaaactcagccgagccctcagatactattatgtaaagaatatcatcaaaaaagtgaatggtcagaagtttgtgtacaagtttgtctcttatccagagattttgaacatggatccaatgacagtgggcaggattgagggtgactgtgaaagtttaaacttcagtgaagtcagcagcagttccaaagatgtggagaatggagggaaagataaaccacctcagcctggtgccaagacctctagccgcaatgactacatacactctggcttatattcttcatttactctcaactctttgaactcctccaatgtaaagcttttcaaattgataaagactgagaatccagccgagaaactggcagagaaaaaatctcctcaggagcccacaccatctgtcatcaaatttgtcacgacaccttccaaaaagccaccggttgaacctgttgctgccaccatttcaattggcccaagtatttctccatcttcagaagaaactatccaagctttggagacattggtttccccaaaactgccttccctggaagccccaacctctgcctctaacgtaatgactgcttttgccaccacaccacccatttcgtccataccccctttgcaggaacctcccagaacaccttcaccaccactgagttctcacccagacatcgacacagacattgattcagtggcttctcagccaatggaacttccagagaatttgtcactggagcctaaagaccaggattcagtcttgctagaaaaggacaaagtaaataattcatcaagatccaagaaacccaaagggttagaactggcacccacccttgtgatcacgagcagtgatccaagcccactgggaatactgagcccatctctccctacagcttctcttacaccagcatttttttcacagacacccatcatactgactccaagccccttgctctccagtatccacttctggagtactctcagtcctgttgctcccctaagtccagccagactgcaaggtgctaacacacttttccagtttccttctgtactgaacagtcatgggccattcactctgtctgggctggatggaccttccacccctggcccattttccccagacctacagaagacataacctatgcacttgtggaatgagagaaccgaggaacgaagaaacagacattcaacatgattgcatttgaagtgagcaattgatagttctacaatgctgataatagactattgtgatttttgccattccccattgaaaacatctttttaggattctctttgaataggactcaagttggactatatgtataaaaatgccttaattggagtctaaactccacctccctctgtcttttccttttctttttctttccttccttccttttcttttctcctttaaaaatattttgagctttgtgctgaagaagtttttggtgggctttagtgactgtgctttgcaaaagcaattaagaacaaagttactccttctggctattgggaccctttggccaggaaaaattatgcttagaatctattatttaaagaaatatttgtgaaatgaattggcatctttaggactaagtgtgctctgttgaatgacttaaagtgagctgttcctaagcagtggaagaagaagaatcattcctattcatacaaagtaagattggagcagtcatactggggagattgttttgtgtgaactataacgtgtaagcaactccatgaaaaggcatcttgtttacctttattcagggtggatctcttagccatatgtatgatcctgtctgaacctgtcaacagagcatggagctagtctatttcactatagaaagatttttagacctggggtttaagacagtttttggaacacctagtaagaatatgggacctcacatctagcacagaaatgctctttgccctctgggtggtatgattatatgcccatggaatacagcatgggaaatgatcacttttaggaggatgaacttggattttgaatatttgaaacatctctgagtaaaagattcgatcagataacttgaaacaacatgtagtggttttctcaattagaagataaccaagtgaaggacctgtctttttcctgttcattttacctcattttctactatacatttatcacctttcctttatgtttaaggttgttagaggttatgatagttttaaagatgcagttaggaaggtagaattcaaagtgaagcctccccagtcaggagcgaagatgtgcttatttcctttttttttttttttttttttttttgagacagagtcttgctctatcacccaggctggagtgcagtggcgcgatctcagctcactgtaagctccgcctcccgggttcaagcaattctcctgcctcagcctcctgagtagctgggactacaggcatgcgccactacgcctggctaatttttgtatttttagtagagacggggtttcaccatgttggccaggatggtcttgatctcttgaccttgtgatccgcccacctcagcctcccaaaggcgcaggctcagatgtgcttatttctttcaactttttttttttaaatggggaagagcagagttcatttgggaatgcttatacatagggattggattgttcatattagtagtaaaaaatgtaggccttattctctacattaccaaatttttaaaatattactatatggtaatcaatgccaggtacagatttgttggttccccaaactgaattgatatcagtatcacagtggagtcttttgaaaattaaagtccaggattaaattatatgttgtcaccattcaccaccactaccaccctcccccaccaatctctcccaccggttaaactcgtcttctaatcctgtagaatcacatgaactaaatgaagaagtaagaacttgaaggctcagactgacactgttacaaactagcatcttcagatgcatggtatttactttaaatgtgcttatatacagtgtagagaagctcttgtataagaagacatctatgctagctaacttagtagtagtagagggaacatattcagtgagctgcctttatatctgtagtgtcggagacttgttactggttcatttgtggttatcagttgaaggttctgttcctgagatgtgcaatagtagtgttgaaaggtattgtttaatagtgatggggaacagacatattggacttttttttccatattaaattatttagtttgcatgcctgtttgaaattggacctctcagcagcactttgaaatagttttaattaggttaacattttgtacattaaataagtagatatagatggttgatttaactagatgtgttaaattttgaaagcacaaaggtattttatctttttgaattaaaggagaaaagccattgatttgttttcacagacagtatttttaataattaactgtctcagcacagaggtaccttggaaccaagggcaccattgaaactcagttgaagcaacttcctagtaaaccattttagtgagtcctttttgcataaatctatagcctctcagaggtgtgaggctgtcacagattggtgatctgctatctctttgagatcaactaatttggagaagtgtgtgtgtgcgtatccttttttaagtcaaagtttacaaccttactgcaggtgtatgaggcagacagttctgtttatagactacctccttcctggaaaagtctcagcttcatattctgttgaatatatgcagaattcttagtgtgaaaggtgatgtaccacttcagatcagttttcactggagagacttgtaattggtagctgtagctcgtatccatccctagtcactttgccaggatgaatgctgttgggcagcagtagcctaagttacggaaggggagcagattgaatggggttttgagacatcttctctgataccttagctttccttctgctctggtcgctatccactcagtcgtgtgctagaaatgtttaacaaccaggatctctggggtgggggtgggggggagcgctgaatttgtagcatttgctgcaaatataaattataaataaaattctaatataaattagaattttatatcaaattctttgatataaattagttactcctcctgtggctgatttcaagctaccaccttagagttcagaaaggatgtgcacagttggctcagagccagtgctggcaaaccattgcatttactccacccaagagtggattttcacataatttctaaaataattttttcttatttatatactgacttttcaaaatacaaaattaaaatatcatgtctgacttcagtgatctttttctttttctttttttagaaatgagatctttcagtaatcctttaatttaattttttagagatggagtcttggtgtgttacccagggtggactcaaactcccgggctcaagtgatcctcctgcctcagcctcctgcatagctgggctacaggcatgcaccaccacacctggcttagtaatccttctttattaatggtttgtcacagtacgtttgtgatgttatattgctcatggcatactttatgtgttcgaacaaaggtggaaatttccattgatttttttttttttaaatgtatgcacaaacaatctggattttgaggagtacggtcaggaaaaaaaaaaaagaattagaggcccttgaaaggtcaaccgtaagcttcttagagttaaaatatgagtttaattttttcccacattttgacagttgaaattttgatagggacagtaaacctatgagcctctattaggctactggattttttttaactggaaaattccttgaagatttacatactatattacagattttaaaagtcaagactgacttaagtaaatcagaggtttggaattctggagctgtaactccaggctgttgatagtatcacttcagttccattcacccctgcattgtgtgacgtccagtctgacaacattgtttcatcctgatctgactttctactatgattcttaagttcttaaaggtgtccttttatgtttttggtgaatgtaagcacatttagagccactcagtaccacttctcaatacctctgaagcagtggttcagaaaaggagtgtccagcctttttgaacacacaaattgatcagtaagagttattgaacataaaaactttccctattaaaaattcatatgggtatatgttaaattatataccgctataccaaagtaatatgtgtgttataaaaaaatacacaaaaattgaagtgaaggatggcataaaaagtaattcttgagtagcagttatagtattttcttcccacaccccagttggttgtcttgtgcaccctccagaagcacacgcttttcctaaagactgctgactcaggatattctcattctaatctccaaacatatatgatgctctcttatgatatatggagaaatcctagagatttggagtttttcaggagagcttattgtcaacttttgaaatttcacattaattctttttgataaattcccaaataataatccattaccacatgttttccacagctttattcctattactttcgtcagcctgttgtctcttatcttcatgttaggtatgactctatttttattttactagtctgctcacagacttctttgggacttatgttatattttaccaacaaatttagaattatttcaagttgctttatgttaaaatatataacaagttacattttcttgctgcattaataagtttttgatttttaaaatctgatatttcagcaactaaaggaatacttttctttataggtctgttctgtttttaacctcattgactgtatatgttttatttacccgtgccaggagtctagaatcgtgcttaggtgccattcttaggtatgaaaacaagtttggagaccaatgcaggtctctgtgcagaaatctggggctctaaatgaattaccaaaccaataggaaagttaaaatactactcatgatgtagtgtgtcatctgaagctatgatagaatatattatttctaaaatagtattgagaagttaattgttcagtccatagtagtgtaagtgaagtgtggaggtcagccatagttgtctttcttcagcaggtactctaaccagagactgggttctgtggaaaatagaattatattcttggtttgggatcaacaaatgttttgttattgttttaatgttgctggcattgcctgaaacaaagtgccctgttattcctcttatgtcatcagaactctgcttactgaagttgaagtttaatcttaggatctagaattcttgtggttggtcgtgtattaagaaaagaaggtggtttgattttatttcttgtacttggtggaacctgttactatacaagtcatgttttgacctgtaagccgagcaaatctgaaaggtgaatcgttaatggtagtataattgtttcatttgaaactgtcagtttcttcaagtcacttctctgaaaaaaattatgatagattgatagcctgccagaaaatagcaatttctaaggtgctgccatccacacttacttattgtgaaatatgaaaatccagagtggtttgtatgagaggggaaatactggctctaagctttctacagaaaacaggaaattcatgctgttgttgacataattttaaaggaaacttttaacaagaaaattcatgagggatacaatcaaacatagttaatctcttgagtgctaatcatttgagtatagtccacatcaggaagttttatgaggttgaaaactttactttgaaatatttaattgggagactagaccatttctttttccaagtcattctgatttattgtcctagtaaatgtatgtgtatgcatatatactgatgtattgactgaatgtgtgtgtgtgtgtgtgtgcgcgtgtaaatctgttttcatagggaacatacattgatggctcctagtctattttatactaaaacttaaaaaaatttgctgcactttgcagttgccactttttaaaagattaatgctttgcacatttcagtaggccttaaagatgaattgctcaccaacattttagaaatacactgcttacatgtgacatactctaaacaaagtcatagtaaactgttctcttaggttcatgtattattgagcaaataaggatgtcctttcttaaaatttctacatttatgtttgcttttgtgtaaaatctttattagtttgtaagtttctcaaagaggaggtttatactggaagcagtatttctaaagtacagagattcgaccatggattgaatacagtagtggaggaatgctggtattgtggcctaatttatccttttaaactgtatgtcattagtattagccaaaacctcagagtggagtgtcttgggctgaatgatcttctcaactttgccttgtttcccatctcataaaggctccttctggttcttttcccttccaaggattgtgagtcatgctcacataggcctgggatcttctggatggggtcggggaggaggtgggggtttcctgtggctggcccagagttctagccaatggaatcattcaagaatgcctaaagttcaggggtgggaatgccatatattggtgttaatcacttggcactttcttgggcaccaatattagcactgtttcatttttaataactggaagcacttaatgattattttgtttgtttaatttcaacttaaggatattgagggtcagagaagtaaggtttatttcttgtttatgttttctggaatttatagggtgtttgtagaagggataaatgggttacctaatgagccattcttctaggctctgtaaggtatgcccttttggctaggatattttaaaataatttgcaagcttttaatattgtgctttgtagaaatttacgatttttaaaaataatttgcaattgatagattacacttaaatttataaagtatccaattttaagtttcttttctgtttggtcattgttgcttattgtctattgtgtaggggacacaatcctgacatttcattgttttgttacttggggcagtattaaccagtggcctttgtatgtacattcattgcttacatttattgtttaagtggtagagtagcatttttatgaacttccctgttcagtattagtgaaattgacagatgcgtatatgtaaagatagaaaagaaacgaatacaattaattttttattccttgaggcctatttatttgttttggccctggatcttttctaatcacaattatatttctttatttttgcctttgagcagtttcatttatctttgtgggcagggaagattaaatatgaaattcagtccagtcattttgctactggttagctttagtttgaggcaagtaaaaatttttgattaaaattagtttcttaaaattatgcccttgctttaccaaataatcaaattggctaaaaaataagggtatgtaactttgcattttgaagaacaaaccaataatttttcatgagccctactcgatcttctttaaagaagaccttcctaagagacaattagggatgagtttgattaatgggaaatagctctaggttagattattttaaattccatacaccaagtgatttaaccacagtggcagtggcagtttctgaaccgtcaagtatgaacatcacttaaaaattaaaagatgcttaataataaactcttaattttcattaagccaatctgtaattcagaagaaaagcatatgtctgccatgggactattgcagtgcgtctccatcagtgttaacacaggagagatatgttattttatgtgtatgtcttagtttgggatatgtggtagtaagaacatgtcaagagtgctttcttcaaacctgtcagctcaactgagaagacagttacttcattgcttattttttcccttgttttattgaaatctgtatctcatatccagtatctaacactttgtagagatacttacatataatgtaagtgcacacctacccagaggaatggataactgttaaagtgttaataatagctcgtcttagttgatttcagcataatttacattagggagacctaaaaagcaccttcaaagtattaaaagcaccttttttttttctttttcctaaaaaagcaattaaaatggtcactgctaacatttattaaacttcatgttagttgatgaaacagctggagggaagctgccacatctcctagctaagcagtctgacttacctgttgggaaacaaagggatattgctctaagattgattaggatgattgtagctagagtcttgaattctatctgtatacggcagagaaactttatagagtgtagagaggtgagcgaaaggatgcaaaagcactttgagggctttataataatatgctgcttgaaaaaaaaaatgtgtagttgatactcagtgcatctccagacatagtaaggggttgctctgaccaatcaggtgatcattttttctatcacttcccaggttttatgcaaaaattttgttaaattctataatggtgatatgcatcttttaggaaagatatacatttttaaaaatctattttatgtaagaactgacagaggaatttgctttgtataatgcaggctggctttacaaaagcactgtagcaaatttactacaagtctaaaagtatacatatatgttaatagatatatgtgcaactagatatggacagcagttgtatttttttaaataaatatttttaacaaaatga

SEQ ID NO: 9415 - DNA, 2512 bp, Homo sapiens
gcggccccaagacccgcgccgccgctgccgcgtgcgggggcggggagggcggggcgccaggagccgcggcggcgggagatgcgggcggctgcgggcacccggcgggctcggcttggccgccgccgccttctacggctccgccgcgggggtcgcagcggctgccgcgccgtcctcgagtttccagcgtgaggaggaggctgagggcggagaggcgcatcgtgttcgaggcggagaccgagggggagccccgcgcgcggcgtcgctcattgctatggacagtgctatcaccctgtggcagttccttcttcagctcctgcagaagcctcagaacaagcacatgatctgttggacctctaatgatgggcagtttaagcttttgcaggcagaagaggtggctcgtctctgggggattcgcaagaacaagcctaacatgaattatgacaaactcagccgagccctcagatactattatgtaaagaatatcatcaaaaaagtgaatggtcagaagtttgtgtacaagtttgtctcttatccagagattttgaacatggatccaatgacagtgggcaggattgagggtgactgtgaaagtttaaacttcagtgaagtcagcagcagttccaaagatgtggagaatggagggaaagataaaccacctcagcctggtgccaagacctctagccgcaatgactacatacactctggcttatattcttcatttactctcaactctttgaactcctccaatgtaaagcttttcaaattgataaagactgagaatccagccgagaaactggcagagaaaaaatctcctcaggagcccacaccatctgtcatcaaatttgtcacgacaccttccaaaaagccaccggttgaacctgttgctgccaccatttcaattggcccaagtatttctccatcttcagaagaaactatccaagctttggagacattggtttccccaaaactgccttccctggaagccccaacctctgcctctaacgtaatgactgcttttgccaccacaccacccatttcgtccataccccctttgcaggaacctcccagaacaccttcaccaccactgagttctcacccagacatcgacacagacattgattcagtggcttctcagccaatggaacttccagagaatttgtcactggagcctaaagaccaggattcagtcttgctagaaaaggacaaagtaaataattcatcaagatccaagaaacccaaagggttagaactggcacccacccttgtgatcacgagcagtgatccaagcccactgggaatactgagcccatctctccctacagcttctcttacaccagcatttttttcacagacacccatcatactgactccaagccccttgctctccagtatccacttctggagtactctcagtcctgttgctcccctaagtccagccagactgcaaggtgctaacacacttttccagtttccttctgtactgaacagtcatgggccattcactctgtctgggctggatggaccttccacccctggcccattttccccagacctacagaagacataacctatgcacttgtggaatgagagaaccgaggaacgaagaaacagacattcaacatgattgcatttgaatgaatccgatgtgcctgatgggttagatttccatatacaagtagcagaggaaaatctgggaacagggtgattccacaggattctgaaatgtccaaattcctgaaaggaagatgaggaagaaagtcctacttgtgtaactgagaagcgtgtggtaatgatctcaaacccagagtatggtccatgcatgaggtgacaaatggagtgaagcgcgcggctgtctccttccttcccatctgggtatctggacagctcttaccaacagtctgaaccagggaagaagataacttgagaagccagggaggacagagtctccgcctgggcaccttctcttaagaactggctttgcacacagccgatgcagtccctgggcactttgaaagcagtgggcaaaagggcaggttacactaaagcaagtcccagatgtcacatcatttcaatgaggagggtatggtgagatgcagctcttcccctccctccagcagggcaaaagaggaggaaaggagaatggagtcacaatgagggagattttggaggccggaagatctagatgtgaggtcctctctgtcagtttctggaagtgtgactgacctagggtccccacataccgaaccaaccagcatctgcagcaccatctcgccaactcctgcccctgtcaccagcactgtggttgcacagcctaacaaaaagagaaggtttggtttggtaaaagcaagttaaggagacagaagccagcattacaatccaggttgctggccaggcacagtggcatatgcatttcggaaggcacatcccagtactttaggagtcagaagtgggaggatctcttgaggccaggagttcaagaccagtctgggcaatatcacaagacttggtctct

SEQ ID NO: 9416 - DNA, 4690 bp, Homo sapiens
catcagttcctaaattcacctgcagggctagggccaggcgcactcaccccacagccagccccactgggcctcggaggcagaatacgggaagaaccgcgaaacaaccctaaaccaattctgaggaccacgaattcggattatccgggagttcttttgccatggcaccgcccccgccacttccgctaggaacccggaagttcctacccgacgccggaagtcccacggccttgcctcctcagattcctctctcacccccacgcagaggagagaacttgcttctggacccgggtgggtgccggctcggctctccttgtcttccagagcggtggcccggaagcacagtcctcccagacgccagcgccagaagctcggatcgcggctgcaccgggagagcgccgatctgggtgcgaggcaggtgcggggccatgaatgggaccgcaaacccgctgctggaccgcgaggaacattgcctgaggctcggggagagcttcgagaagcggccgcgggcctccttccacactattcgttatgattttaaaccagcatctatagacacttcctgtgaaggagagcttcaagttggcaaaggagatgaagtcacaattacactgccacatatccctggatccacaccacccatgactgtgttcaaggggaacaaacggccttaccagaaagactgtgtgcttattattaatcatgacactggtgaatatgtgctggaaaaactcagtagcagcattcaggtgaagaaaacaagagctgagggcagcagtaaaatccaggcccgaatggaacagcagcccactcgtcctccacagacgtcacagccaccaccacctccaccacctatgccattcagagctccaacgaagcctccagttggacccaaaacttctcccttgaaagataacccctcacctgaacctcagttggatgacatcaaaagagagctgagggctgaagttgacattattgaacaaatgagcagcagcagtgggagcagctcttcagactctgagagctcttcgggaagtgatgacgatagctccagcagtggaggcgaggacaatggcccagcctctcctccgcagccttcacaccagcagccctacaacagtaggcctgccgttgccaatggaaccagccggccacaaggaagcaaccagctcatgaacaccctcagaaatgacttgcagttgagtgagtctggcagtgacagtgatgactagtgctggatctttcgaaacctactttttggtgcacaaacatgccgcaagactgagctactttggcgtggagtccattgcaagaggaaaatgttatggatcagtgactgtagtaggagtttgaggctctggaactctcacatattcaagtctttaacttagtggtgatgggtgattttctcgtgtcatttttgaacaatctcatctttcaaagtttaagtagacctgtagaagagctaacagaattatatttctatttagttaaaattgttaatgaaaaacagataaatgtgccctggtctaagttactcaaaggccatatcttcaccaggccagagattcagttttaaacctcagcagccatcagtttggccaagtggttggtaccagtggaatgaagtctttgatgggtaggagagagagggaaaacctcaaactacatcatagaagtatgttaaaaccactttaaattgttgacacaaagtggtaaggaagttttgtctgactcagcctgacaagcctggatagaaatggacctcagaatacagaatggagtccttgagtgtcagttggtgaggaccatggagtcctgccagctcaacctgtcatttacagactaagaaagggaagtacacacctggcttgtggccagtctcctgccccctctctgggctttcctcactgttctctcccttgaatctcatttgtaggaatcaagagattcctatacatgggacttttagatgtacattggcacttggattagattccaaaagacaaaagtgttgggtgcttctagcttgaattcagtccctaaatacatgaggctgggtgagcagatgaaaccggtagccactgtgctgatgcatgtgactccattcagttggggattttggttccatgtggatccatactaagtattcttcagtcagtggattttagcaaggggaggtaggagtggaagagaggtgtgaagaaacctctccgaacaaatgaaccagcagtaagtttctaaaaatcagaatctagatagaagttctgcaatatgaaatgagcacattctttgataaggcgtatctattcatgcttttgtaccactgttttgtacctgactccctgaccgatttgtattttttatatacaactagaaggaagtcacaagattgccttctacagtgtgccatttccaaatggatctgttgttggaggaaactggttgctagtcaatgttctatatttaatgaatgtgtgataaatcatcctgtaatcagtatggagtaacctgtttttgtagtttggatgaatatgtcctgagaaatttccatccactttggttcagcggacatcaaggtagtaataataatttttcctccacaggtccctccactcatatggcctctccctccccagctagtggaggggaagcagtctggacttagaaaggaaataggtggtctgtcataggggctttcattagagttaaacttcatagagtcaactgtttcatcatcatagtgagcccagagagccactgcccagcagcatgctcacaccacctaccctagtgtaggtaataggtctacgctaggaccccgtgctgggctctcagcccatcatgagattttggtggatttaatggcaggtaggaacttatttatagtggattgataattgctttataattccttggtaatgacagctcagggaaggtttcacaaggtcatgatcaggagacttgaattgttactggatgtaggaattgtttcactgctcttaacttgctcaaactggggcaggttccaggaacttgaactaaaaatatctatttaagcctctctctctttctctcctccccaacttttttctgaaagccttgatttctgtagacagaactatggtttttggcatgttgggtcaagacgtgtttctataggaaatgcttgcacgtggcactggcttggtgagtcaagcttcctgagcttcagaccgtttgtcctgtcatctgtcctgcccaacactgtatggtttttctctagcacggcttcaattttgttctctgcacaaagcctttggtggttctgccctctgccctccagctttacccaccagagtaagcaatcttttctttttagaaatcaagaatttggcttcacagatggcttctcacagatgccctcctgccagccaaaccggacttgttcttcctgcctctgtgccttctctcattctccttctctccctccataccccacttttgaggttctgtgggtaccatctttgtggactcttgtcttttttttcaacccacatggagtgccctgtgtgtacatactgaccttttttttttttttttttttttgcttgaactctggtcggtatgagctccttaaaagcaggtactgggctggctgtggtgactcatgcctgtaatcccagcactttgggaggctgaggtgggaggattgcttgagtccaggagtttgagaccagcctgggcaacatggcgagaccctgtttctacaaaaagaaaaagggaaaaaaaaagcagggactgtcattctcatctcctccctggggtatccacaggaatggacattcaaatggttgtagcctggtggggtagaaggcagagaagactacccagccagtgaagtgcagaggatagacataggaaaacattccaggcatttggagacagctgaaagtatccatgctgactttcatgatttagaagtctttaactgaattattaaaattgccttttttttgtgctgtacaatgtctactgtactgtgggtcatttagatgagatgaaaaacttaattaaatctgaagtgtcagaggcgcttagtaagccttagtaaagttgtgattgaagaaacttaatacaaatgaactagaggtttgtaatcatgccactcactaacgattttatttctgtagcagaatcattttttctatgtaaggtgttaatgtgtgtgtatgtgctttggttgtaggaaaacttgaaaattccaaaatccttattttcctatttgagaggctggttcagcagggtgtgtgtgtgtgtgtgtgtgtgtgtgtatgaatggtatatttattacattattttgaaagagaattagtgtgttatgtggataatgttatatacagccaaagtggatgtttctatttggcaaggaaggtaggatttctgaaactcaggccttaaccaataggttggaagacaagaccaattgaagagttaggaaatgtgagtttttgttacttctgttattccagtcttggtttcattgtctcattctttatttttaaaatcttgtgcctaaaagtttttttgcttaattatgaagtagacatgcatgtttacatttatgtaaaatatttgctgtgtaaagtattttttgtttattctcttaaaagatcactatatttaaataaaagtgaaggtcagcaacaca

SEQ ID NO: 9417 - DNA, 1037 bp, Homo sapiens
ctctctcacccccacgcagaggagagaacttgcttctggacccgggtgggtgccggctcggctctccttgtcttccagagcggtggcccggaagcacagtcctcccagacgccagcgccagaagctcggatcgcggctgcaccgggagagcgccgatctgggtgcgaggcaggtgcggggccatgaatgggaccgcaaacccgctgctggaccgcgaggaacattgcctgaggctcggggagagcttcgagaagcggccgcgggcctccttccacactattcgttatgattttaaaccagcatctatagacacttcctgtgaaggagagcttcaagttggcaaaggagatgaagtcacaattacactgccacatatccctagctgagggcagcagtaaaatccaggcccgaatggaacagcagcccactcgtcctccacagacgtcacagccaccaccacctccaccacctatgccattcagagctccaacgaagcctccagttggacccaaaacttctcccttgaaagataacccctcacctgaacctcagttggatgacatcaaaagagagctgagggctgaagttgacattattgaacaaatgagcagcagcagtgggagcagctcttcagactctgagagctcttcgggaagtgatgacgatagctccagcagtggaggcgaggacaatggcccagcctctcctccgcagccttcacaccagcagccctacaacagtaggcctgccgttgccaatggaaccagccggccacaaggaagcaaccagctcatgaacaccctcagaaatgacttgcagttgagtgagtctggcagtgacagtgatgactagtgctggatctttcgaaacctactttttggtgcacaaacatgccgcaagactgagctactttggcgtggagtccattgcaagaggaaaatgttatggatcagtgactgtagtaggagtttgaggctctggaactctcacatattcaagtctttaacttagtggtgatgggtgattttctcgtgtca

SEQ ID NO: 9418 - DNA, 6431 bp, Homo sapiens
ccctccggctcggcgaagcagggaaggggagagaagcaggagtcgggagactgcacaggccagaaagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccagaaagacgacactcaaaatctgctcaagaatttggagtctaatgcgcagaccccctcggaaactggctccccatcaaggaggaggaagagagaagtgcagatgtcgaaggacaaggaagctgttgatgaatgtgagccgccttccaacagcaatatcacagcattcgccctgaaggccaaagtcatctaccccatcaatcagaagttccggcctctggccgatggctcctccaacccgtctctgcatgaaaacttaaagcaggctgttttgccacaccagccggtagaggcctctccttccagcagtctggggagcctgagccagggtgagaaggacgactgcagctcctcatccagcgtccactcggccaccagcgatgacaggtttctcagccgcaccttcctccgggtgaacgccttccctgaagtgctggcctgcgagagtgtagacgttgacctgtgtatctacagccttcacttaaaagacctgctgcatttggacacggcactgaggcaggaaaagcatatgatgtttattcagatttttaaaatgtgcctccttgaccttcttcctaaaaagaagtcagatgatgaactataccagaagatcctttcaaaacaagaaaaagatttggaggaactagaaaagggacttcaggtcaaactgtcaaacacagaaatgtcgggggctggtgactctgagtacatcaccctggctgatgtggaaaagaaggagagagaatactctgaacagctaatcgataatatggaagctttctggaaacagatggcaaatatccagcactttcttgtggaccagtttaagtgttccagctccaaagcccgacagctgatgatgactctgacggaaagaatgattgcagccgaagggctattgtgcgattctcaggagctgcaggctctggacgccctggagaggacgatggggcgggcgcacatggcaaaagtgattgagtttctgaagctgcaagtccaggaggagaccaggtgccggctggctgccatctcccacggcctggagctgctggctggtgaggggaagctgtccgggcggcagaaggaggagctgctcacgcagcagcacaaggccttctggcaggaggcagagcgcttcagccgggagtttgtccagcgaggcaaagacctggtcacggcgtctctggctcaccaggtggagggaacggcaaaactcacgctggcccaagaggaggaacagagaagcttcctggctgaggcccagccgactgctgacccggaaaagtttctcgaggcttttcatgaggtcctggagaggcagaggctgatgcagtgtgacctggaggaagaggagaatgtcagagccaccgaggctgtggttgcactctgccaggagctgtacttcagcaccgtggacactttccagaagttcgtggatgccctgttccttcagacgctccctggcatgactggcctccccccggaagagtgtgactacttgaggcaggaagtccaggagaacgctgcctggcagctggggaagtcaaatcgcttccggaggcagcagtggaaactcttccaggagctcctagagcaagaccagcaggtgtggatggaggagtgtgcgctgtccagcgtgctgcagacacacctgcgggaggaccacgagggcaccatccgcggcgtcttgggccgactgggcggcctcactgaagagtccacgcggtgtgtcctgcaggggcatgacctgctgttgcgctcagccctccggaggctggcactccgcggcaacgccctggccaccctgacgcagatgcggctatcggggaagaagcacctcctgcaggagctgcgggaacagcgtgcactggagcaggggtcctcccagtgcctggacgagcatcagtggcagctgctcagggccctggaggcgcgtgtgctggaggaggccagccggctagaggaggaagcacagcagacacggctgcagctccagcagcggctcctggccgaggcccaggaggtggggcagcttctgcagcagcacatggagtgcgccattgggcaggcgctgctggtgcatgcacggaatgcagccaccaagagccgggccaaggacagggatgacttcaagaggacactgatggaggcggcagtggagagcgtctacgtgaccagcgctggtgtcagccgcctggtgcaggcgtattaccagcaaatcggaaggatcatggaggaccacgaggagagaaaactgcagcacctgaagaccctgcagggtgagaggatggaaaattacaaactgcggaaaaagcaagaactcagcaacccttcgtcgggcagcaggacggcaggtggcgctcatgagacctcccaggcggtccaccagaggatgctgtcccagcagaagaggttcctggcccagttcccagtgcaccagcagatgcgtctgcacgcccagcagcagcaggcaggagtcatggaccttctggaagcccagctggagacccagctacaggaagctgaacagaacttcatctccgagctggcagccttggcccgagtgccccttgctgaaagcaaactgttgcctgctaagcgtgggctgctagagaagcccctaaggactaaaaggaagaagcccctgccccaggaaagaggggacctgggggtgcccaacaatgaggaccttgcctccggggaccagacctcaggctcactcagcagcaaaaggctgagtcagcaagaaagtgaagctggggacagtgggaactcaaagaagatgctaaagagaagaagcaacttgtagtttaagaccagtcggtgggacaagacctgaagccctgggtctgggtgtgaattccaccttccctcctgcagtgctgagaggcagcgaggacggagaggacagcggcatctctaggctcttctgagagggacagagaaagaatagaaatgtgccctaaaagcataaatgagtatcacctgagaaaattaggcattcccgtcttggaaacacgtctctgtgagtttgcatttcatttggcttggagccctggctcgatgcctcatggatctttctccccaaggagggacgtcttgaggggtccgagcctcaggccaaggacccctgatgcagactctggaatccctggcccaaaggcctgtctgggcccatctggggctgaggacacacagatacataatgacacctgcagaaatgtattctctgaggacacttagaatatgaggaagagggtgtggcccaaccctcacttcacctggggaggggcttcttccggacagtagacaccctgcccgtgcagagagatgtcatgggggcacctgctctccctgatagatgctgagagcatccagaaacttccagaccagccctctcaccacacccagaagaggcctttcccatctggagagaagcttccagaccagcccttcacacaccacagccaggaggggcctttcccacctggagagaaacttccagaccagcccctcataccacagccaagaggggcctttctcacctggagagaaatttccagaccatcccctctcaccacagccaggagaggcctttcccaccggtagagaaacttccagaccagcccctcacaccacagccaagagaagcctttccagcctggagagaaacttccagaccagccctctcactacagccaggagaggcctttcccgcctggaaacttccggacaagcctctcacacaccacagccaggagaggcctttcccacctggacagaaacttccagaccagcccctctcaccacagccaggagaggcctttaccacctggagagaagcttccagaccagcccctcacaccacagccaggagaggcctttcccacctggagagaaacttccagaccagcccctcataccacagccaagaggggcctttctcacctggagagaaacttccagaccagcccctcacaccaccgccaggagaggcctttcccaccgggagagaaacttccagaccagcccctcacaccacagccaggagaggcctttcccaccgggagagaaacttccagaccagccctctcactacagccagaagaggcctttcccaccgggagaggaacttccagaccagcccctcacaccacagccaggagaggcctttcccgcctggagagaagcttcaggccagctcctcacaccacagccaggagagaccttttctgcctggagagaaactttcagaccagccccacacaccacagccaggagaggccgttcctgcctggagagaagcttccagaccagcccttcacaccacagccaggagaggcctttcccacctggagagaaacttccagaccagcccctctcaccacagccaggagaggccgttcccacctggagggaaaattgctcctttgatggaggttagggactgtcaccctcagcactgtgaacataccgggcgagatcattcttcaggggaaggagctgcccagagcatcacaggatgttccagtgtccctggtctctgcccaccagatgccagcactcccaccattcgtggcaaccaaggatgtctccagacactgccccgtgtccatggggttatcacccactgtgctgagtcaaagggtgccttgccctggtctaatccaggacatagccgtggatacgtccaaaaatccccagaacctagtgagccctctggctctgggagcccctatctcaggaattttcagggtcatttgtgacttttcatttcttaaaacctgaaatagactctcttagaaacaagtgactccttcccagtggccaaaacttaatcatcagagcgcttccttcagttcctcacccatcagccagtgggctctccaaagttaaccaacagctccctcttgtggttcactaaaaaacttggttattccatggagttgtgcaaagctatggcttccttggtgcaatattcttaaaacctgctttgcatagaaatcacttttgcccaggctggagtgcagtggcgtgatctcggctcatggcaatctccatctcccgggttcaagcgattttcctgcctcagcctccccagtagctgggactacagacgtgtgccaccacgcctggctaaatcttttttgtattttattttagtagagacggggtttcaccatactggccaggctgctctcgaactcctgacctcatcgtccacctgcctcggcctccccaaagtgctgagattaggcgttagccaccgcgcccggccagaaatcacttttatattgtcacatgggccctctgcacagagtccgatggctcctcccggggaagcctgattttgtgacgtgtgtatagtaaatgcaggccctctggcagcaccataattggtcggttaccctgagcccagagctctgaaagcatctgtggaatgatcacgggacccttctcctctgagaaggctcccggctgcctccccgccaccgagcttgtagcctgaatgcctggctgtcgcatggagcattttgcttctggggtgtcttccttagccaaagggaacgtgtcatttgctcgaccctggcccacccttgccgcccagctgttgtgctgggcacagtctggggcacaggcctccatgatgaagacgcgtgggctgtcggtgctttcatccgtcacaaactggcacctgtacctgccagcaggagcatgatggggacttccatgctggaattgctccctgattaaaatgagatatggctatttggaagacactgcattttagccagtgtacctgggcacagactcggggctgccctgaagctgatgaaggcttgaaggacggaagggctgagccacatgaaggcagcactcagggccaggggagagagaagaggatcagcagtgcagccccaggatgcctcgcaggtaccctgcctccattttggttaccatccccacttattatgggctgtgggctgttatggtgatggatggatgtggatttggaaggggaccatgagagatgatgtattatgatgaactcatgatttaattctttggtgaaaata

SEQ ID NO: 9419 - DNA, 7063 bp, Homo sapiens
ccctccggctcggcgaagcagggaaggggagagaagcaggagtcgggagactgcacaggccagaaagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccagaaagacgacactcaaaatctgctcaagaatttggagtctaatgcgcagaccccctcggaaactggctccccatcaaggaggaggaagagagaagtgcagatgtcgaaggacaaggaagctgttgatgaatgtgagccgccttccaacagcaatatcacagcattcgccctgaaggccaaagtcatctaccccatcaatcagaagttccggcctctggccgatggctcctccaacccgtctctgcatgaaaacttaaagcaggctgttttgccacaccagccggtagaggcctctccttccagcagtctggggagcctgagccagggtgagaaggacgactgcagctcctcatccagcgtccactcggccaccagcgatgacaggtttctcagccgcaccttcctccgggtgaacgccttccctgaagtgctggcctgcgagagtgtagacgttgacctgtgtatctacagccttcacttaaaagacctgctgcatttggacacggcactgaggcaggaaaagcatatgatgtttattcagatttttaaaatgtgcctccttgaccttcttcctaaaaagaagtcagatgatgaactataccagaagatcctttcaaaacaagaaaaagatttggaggaactagaaaagggacttcaggtcaaactgtcaaacacagaaatgtcgggggctggtgactctgagtacatcaccctggctgatgtggaaaagaaggagagagaatactctgaacagctaatcgataatatggaagctttctggaaacagatggcaaatatccagcactttcttgtggaccagtttaagtgttccagctccaaagcccgacagctgatgatgactctgacggaaagaatgattgcagccgaagggctattgtgcgattctcaggagctgcaggctctggacgccctggagaggacgatggggcgggcgcacatggcaaaagtgattgagtttctgaagctgcaagtccaggaggagaccaggtgccggctggctgccatctcccacggcctggagctgctggctggtgaggggaagctgtccgggcggcagaaggaggagctgctcacgcagcagcacaaggccttctggcaggaggcagagcgcttcagccgggagtttgtccagcgaggcaaagacctggtcacggcgtctctggctcaccaggtggagggaacggcaaaactcacgctggcccaagaggaggaacagagaagcttcctggctgaggcccagccgactgctgacccggaaaagtttctcgaggcttttcatgaggtcctggagaggcagaggctgatgcagtgtgacctggaggaagaggagaatgtcagagccaccgaggctgtggttgcactctgccaggagctgtacttcagcaccgtggacactttccagaagttcgtggatgccctgttccttcagacgctccctggcatgactggcctccccccggaagagtgtgactacttgaggcaggaagtccaggagaacgctgcctggcagctggggaagtcaaatcgcttccggaggcagcagtggaaactcttccaggagctcctagagcaagaccagcaggtgtggatggaggagtgtgcgctgtccagcgtgctgcagacacacctgcgggaggaccacgagggcaccatccgcggcgtcttgggccgactgggcggcctcactgaagagtccacgcggtgtgtcctgcaggggcatgacctgctgttgcgctcagccctccggaggctggcactccgcggcaacgccctggccaccctgacgcagatgcggctatcggggaagaagcacctcctgcaggagctgcgggaacagcgtgcactggagcaggggtcctcccagtgcctggacgagcatcagtggcagctgctcagggccctggaggcgcgtgtgctggaggaggccagccggctagaggaggaagcacagcagacacggctgcagctccagcagcggctcctggccgaggcccaggaggtggggcagcttctgcagcagcacatggagtgcgccattgggcaggcgctgctggtgcatgcacggaatgcagccaccaagagccgggccaaggacagggatgacttcaagaggacactgatggaggcggcagtggagagcgtctacgtgaccagcgctggtgtcagccgcctggtgcaggcgtattaccagcaaatcggaaggatcatggaggaccacgaggagagaaaactgcagcacctgaagaccctgcagggtgagaggatggaaaattacaaactgcggaaaaagcaagaactcagcaacccttcgtcgggcagcaggacggcaggtggcgctcatgagacctcccaggcggtccaccagaggatgctgtcccagcagaagaggttcctggcccagttcccagtgcaccagcagatgcgtctgcacgcccagcagcagcaggcaggagtcatggaccttctggaagcccagctggagacccagctacaggaagctgaacagaacttcatctccgagctggcagccttggcccgagtgccccttgctgaaagcaaactgttgcctgctaagcgtgggctgctagagaagcccctaaggactaaaaggaagaagcccctgccccaggaaagaggggacctgggggtgcccaacaatgaggaccttgcctccggggaccagacctcaggctcactcagcagcaaaaggctgagtcagcaagaaagtgaagctggggacagtgggaactcaaagaagatgctaaagagaagaagcaacttgtagtttaagaccagtcggtgggacaagacctgaagccctgggtctgggtgtgaattccaccttccctcctgcagtgctgagaggcagcgaggacggagaggacagcggcatctctaggctcttctgagagggacagagaaagaatagaaatgtgccctaaaagcataaatgagtatcacctgagaaaattaggcattcccgtcttggaaacacgtctctgtgagtttgcatttcatttggcttggagccctggctcgatgcctcatggatctttctccccaaggagggacgtcttgaggggtccgagcctcaggccaaggacccctgatgcagactctggaatccctggcccaaaggcctgtctgggcccatctggggctgaggacacacagatacataatgacacctgcagaaatgtattctctgaggacacttagaatatgaggaagagggtgtggcccaaccctcacttcacctggggaggggcttcttccggacagtagacaccctgcccgtgcagagagatgtcatgggggcacctgctctccctgatagatgctgagagcatccagaaacttccagaccagccctctcaccacacccagaagaggcctttcccatctggagagaagcttccagaccagcccttcacacaccacagccaggaggggcctttcccacctggagagaaacttccagaccagcccctcataccacagccaagaggggcctttctcacctggagagaaatttccagaccatcccctctcaccacagccaggagaggcctttcccaccggtagagaaacttccagaccagcccctcacaccacagccaagagaagcctttccagcctggagagaaacttccagaccagccctctcactacagccaggagaggcctttcccgcctggaaacttccggacaagcctctcacacaccacagccaggagaggcctttcccacctggacagaaacttccagaccagcccctctcaccacagccaggagaggcctttaccacctggagagaagcttccagaccagcccctcacaccacagccaggagaggcctttcccacctggagagaaacttccagaccagcccctcataccacagccaagaggggcctttctcacctggagagaaacttccagaccagcccctcacaccaccgccaggagaggcctttcccaccgggagagaaacttccagaccagcccctcacaccacagccaggagaggcctttcccaccgggagagaaacttccagaccagccctctcactacagccagaagaggcctttcccaccgggagaggaacttccagaccagcccctcacaccacagccaggagaggcctttcccgcctggagagaagcttcaggccagctcctcacaccacagccaggagagaccttttctgcctggagagaaactttcagaccagccccacacaccacagccaggagaggccgttcctgcctggagagaagcttccagaccagcccttcacaccacagccaggagaggcctttcccacctggagagaaacttccagaccagcccctctcaccacagccaggagaggccgttcccacctggagggaaaattgctcctttgatggaggttagggactgtcaccctcagcactgtgaacataccgggcgagatcattcttcaggggaaggagctgcccagagcatcacaggatgttccagtgtccctggtctctgcccaccagatgccagcactcccaccattcgtggcaaccaaggatgtctccagacactgccccgtgtccatggggttatcacccactgtgctgagtcaaagggtgccttgccctggtctaatccaggacatagccgtggatacgtccaaaaatccccagaacctagtgagccctctggctctgggagcccctatctcaggaattttcagggtcatttgtgacttttcatttcttaaaacctgaaatagactctcttagaaacaagtgactccttcccagtggccaaaacttaatcatcagagcgcttccttcagttcctcacccatcagccagtgggctctccaaagttaaccaacagctccctcttgtggttcactaaaaaacttggttattccatggagttgtgcaaagctatggcttccttggtgcaatattcttaaaacctgctttgcatagaaatcacttttgcccaggctggagtgcagtggcgtgatctcggctcatggcaatctccatctcccgggttcaagcgattttcctgcctcagcctccccagtagctgggactacagacgtgtgccaccacgcctggctaaatcttttttgtattttattttagtagagacggggtttcaccatactggccaggctgctctcgaactcctgacctcatcgtccacctgcctcggcctccccaaagtgctgagattaggcgttagccaccgcgcccggccagaaatcacttttatattgtcacatgggccctctgcacagagtccgatggctcctcccggggaagcctgattttgtgacgtgtgtatagtaaatgcaggccctctggcagcaccataattggtcggttaccctgagcccagagctctgaaagcatctgtggaatgatcacgggacccttctcctctgagaaggctcccggctgcctccccgccaccgagcttgtagcctgaatgcctggctgtcgcatggagcattttgcttctggggtgtcttccttagccaaagggaacgtgtcatttgctcgaccctggcccacccttgccgcccagctgttgtgctgggcacagtctggggcacaggcctccatgatgaagacgcgtgggctgtcggtgctttcatccgtcacaaactggcacctgtacctgccagcaggagcatgatggggacttccatgctggaattgctccctgattaaaatgagatatggctatttggaagacactgcattttagccagtgtacctgggcacagactcggggctgccctgaagctgatgaaggcttgaaggacggaagggctgagccacatgaaggcagcactcagggccaggggagagagaagaggatcagcagtgcagccccaggatgcctcgcagacgtgccttctgccatgattgtgaagttctagccacgtggaactctctcggaagaactggttgttaaagagcacctctgccttcttcctctgttgccatgtgatctctgcacacgctagctctccttcgccttctgccatgctggaagtagcctgaggccctcaccagaagcagacgctggcaccgtgctgcttgtacagcctgcagagccgtgagccaagtaaacctctttaattacccagcctcaggtgctccgggaacgccttccgcggaatgaagcggcccatgcccttgttgacgttgatgtttccgtcttcaaagacgatcttgccctggctgatgaccactagtggggagccgtggcactccataccctcgaagatgttgtactccaccgcctgcaccaacagcctcagtgttacttcccaggatttgctctgccccaaacgagctgttcataacagcgattttgcctaacattatatcataagcgtgttccaatgtttttttttctctctaaaaataccttttattgactgtaatattccactgtatggtccacagtgtatataaccaacaactcaccgttgcgcatgtaggctgccggtggctttctataatcaaatcaatattgttctggggcatcacaaagaggaagggggtcccccggggttatgcaatgtggctgctttgactgtactggacataaaaataagtaaaatgttcttcattttacttaaaatgtgtctttaaataaaatttttttctctaggtt

SEQ ID NO: 9420 - DNA, 4828 bp, Homo sapiens
ttataaattctcagcttctcgaaccccatggccttgtccatgttaggtcaggaaaggcctgtccttggatggtctgggttatggggagagaggctgccaggggccaggctcgctggcctgagactttatagacagcctaacagcctgccccgcaggaaggctggcgggagtggagccctcccccgtcaacaggtgtcagctgtcacccaggacctaggcagggatgaggaagcacacaaaaggctccaccagtccccctttttgtgtctttctcctcctcctcctcctgcgtcccttggcaaagcaaatccctgtcccctcggagagttcagggagagcttgcttagggctgcgacttcagacaccagctcccctctttctaggtccccagagaggtggcccagcggctggcctgtttcccactgggaatgcgaggggcacccgggccggcccagggctgacccacagcaggctcgggcagtgggtgctcagctggtctgcactgaacgcaaccggaagtgagggtccttttccttctctgcggccaccccctcctccccgagctttcctgaaccttctgggtgctccaggactcccggccccgcgctccaaatgcttctccgttttctaagcggggatggggaaactctggattcacatccgtgtgtcaggaaaccgttcccaggggaagtgcgtctgagctgaggcttacagacccaggacttgccctgtatgatttggcccaaagtggaatgctgtcactttaagactgcagtggaagcaccacttggaatgaaattggacaagaaaatggaagtcttcatcccactctcaacttctgcagcctctagtgggccatgggctcattccttatttgcttttataccctcctggcctaagaagaacttatttaaaagagagtctcctataacacaccgcctgtatggggacatttcaagagaagttcaagggacttctgaaaatggagtaatttttcagaaatgtgcactggtgtctgggtcgagtgaagcacagacagcccgcatatggctgcttgttaacaacaccaagacaacctcgtcagccaacctctcggagctgctcttgctggacagcattgctggtctcaccatttgggactctgtgggaaacaggacctcggaaggattccaggcttttagcaagaagtttctgcaagtgggagatgcctttgctgtcagctacgcagccacgctccaggctggagacctcgggaacggggagagcctcaagcttcctgcccaactcacctttcagagctcgtcacggaacagaacacagctgaaagtgcttttttccataacagcagaagaaaacgtaacggttctgccgcaccacggcctccacgcagcagggttcttcattgccttcctcctctcccttgtgctgacctgggctgccctcttcctcatggttcgctatcagtgtctgaagggaaacatgctcaccagacatcgggtttggcagtatgagagcaagctggaacccttgccgttcacctcagctgatggcgtgaatgaggacctttcccttaacgaccaaatgatagacattctgtcttccgaggaccctgggagcatgcttcaagccttagaagagttggagattgcaaccctgaatcgggcagatgcagatctggaggcttgtcgaacacaaatcagcaaggatatcattgcccttctgctgaaaaatctcaccagcagtggccacctctcaccccaagtagagagaaaaatgagtgctgttttcaaaaagcagtttctattgctggaaaatgaaatacaagaggagtacgatcggaagatggtggcattgacagctgaatgtgacctggaaacaagaaagaagatggaaaaccagtaccagagagagatgatggcaatggaggaagcagaagagttgctgaaacgtgctggtgagaggtctgctgtagagtgcagcaaccttctgcggaccctccatggcctggaacaggagcacttgaggaagtctctcgctttgcaacaagaagaagactttgccaaagctcacagacagctggctgttttccagagaaatgaactgcacagtatcttttttacccagataaaaagtgctattttcaaaggggaattgaaaccagaggcagctaaaatgctgctgcaaaattattctaaaatacaggagaatgtagaagagttaatggactttttccaggctagtaagaggtatcatctaagtaaaagatttggccacagggaatatctggtccagaacctccagtcatcagagacccgtgtgcagggccttctgagcaccgctgcagcccagctgactcacctcattcagaagcacgagagagcagggtacctggatgaagaccaaatggaaatgctattggagcgggctcagacagaagtcttttcaatcaagcagaagttggacaatgacttaaagcaggaaaagaaaaagctccaccaaaaattaataactaagagaagacgagagttgctacaaaagcacagggagcagcgtagggagcaggcgtccgtcggcgaggccttccgaacggttgaggatgccggccagtacctgcaccagaagaggagcctgatggaggagcacggtgccaccctggaggagctgcaggagcgtctggaccaggccgccctggacgatctcaggaccctgaccctttcgctgtttgaaaaggccaccgacgagctgcggcgcctgcagaactcagccatgacccaggagctgctcaagcgtggggtgccctggctcttcctgcagcagatcctggaggagcacggcaaggagatggctgcacgggccgagcagctggagggggaggagagggacagggaccaggagggtgtccagagcgtgaggcagagactgaaggatgacgctcctgaggccgtgacagaggagcaggcagagctgcgacgctgggagcacctgatcttcatgaagctctgctcctcagtcttctccctgtctgaagaggagctgctcaggatgaggcaggaggtccatggctgctttgctcagatggacaggagcttggccctccccaagatccgggcccgagttctgctgcagcaatttcagactgcgtggcgagaagcagagttcgtgaagctggaccaggccgtggctgcccctgagctgcagcaacagtccaaggtgagaaagtcacggtccaagagtaaaagcaagggagagcttctgaagaagtgcatcgaagacaaaattcacctctgtgaggaacaggcctctgaagacctggtggaaaaggttcgaggtgaattgctgcgggagagagtgcagcggatggaggcacaggagggaggctttgcacagtcgcttgttgctctgcagttccagaaggcgtcccgggtgaccgagactctgtcggcctacaccgccctcctcagcatccaggacttgctcctggaagagctgagtgcatctgagatgctgaccaagtcggcctgcacacagatcctggagtcgcacagccgggagctccaggagttggagaggaagctggaggaccagctggtgcagcaggaggcagcccagcagcagcaggccctggcgagctggcagcagtgggtggccgatgggcccgggattctgaacgaacctggggaggtggattctgaaaggcaggtctctactgtcctgcaccaagccctgagcaagagccagacattactggagcaacatcagcagtgtttgagagaggaacaacagaacagtgtcgtgctagaagacttgttggaaaacatggaggcagacacctttgcaaccctgtgcagccaggagctgagactggcatcgtacctggcgaggatggccatggtgcccggggccacgcttcgccggctcctgagtgtggtactgcccacagcctcacagcctcagctgctggccctgctggattcggccaccgagagacatgtggaccacgcagctgagagcgatggcggagcggagcaggccgacgtgggcaggcggaggaaacaccagagctggtggcaagccttagatggcaaactgcgaggagatctgataagcagaggattagaaaagatgctgtgggcccgcaagagaaagcagagcatattaaagaagacatgtctccctctcagagagaggatgatattctctggaaaaggaagttggccacacctgtcactggagcccattggcgaactggcccctgtacccattgtaggggcagaaaccattgatctattaaacacaggagagaagctctttatattcagaaatccaaaggagccagagatctcactgcacgttcctcccaggaaaaagaagaactttttgaatgccaaaaaggccatgagggccttgggcatggactagcccaagggaaagacctgcgggagcatctgaagagagaagggatgattttctcctgcccgccggtgtttgtgtgtttataatgcacaactcgcaaatataaattgcacatgcagaaggcacagaccccgtagcgcatgccaacttgcagggactcggtttaatcttgtctcatgaatttccagatggcccactctcttccatatcacaaggacataaacactccttctttcagccccacctccccagggccctggaggagacccccaccctgcaatccacaccccatcctctgctgcagaagctatggtctgtgtggtgacagccagattctctactcttatgttttgtatttgttacatattctatttttataaagggaattttaaaaaataaatgtgttttgcacaaa

SEQ ID NO: 9421 - DNA, 4390 bp, Homo sapiens
gctccagcgactcggcggcacccgccgctttgaggtagcgggtcccgacaggcgatggacccctcgggctcccgggggcgccccacgtgggtgctggccgggggtctcctggcagtggccctggcgctggggggccgaggctgtctcggcgccagctcacgtccccgctggcgccccctcggcgcgcagccaccccgggatccccaggtggctcctaggtctgggcccggcctgaggatccctccggggcggagcggggcggggcccgagagcagcacgcaggacttgccctgtatgatttggcccaaagtggaatgctgtcactttaagactgcagtggaagcaccacttggaatgaaattggacaagaaaatggaagtcttcatcccactctcaacttctgcagcctctagtgggccatgggctcattccttatttgcttttataccctcctggcctaagaagaacttatttaaaagagagtctcctataacacaccgcctgtatggggacatttcaagagaagttcaagggacttctgaaaatggagtaatttttcagaaatgtgcactggtgtctgggtcgagtgaagcacagacagcccgcatatggctgcttgttaacaacaccaagacaacctcgtcagccaacctctcggagctgctcttgctggacagcattgctggtctcaccatttgggactctgtgggaaacaggacctcggaaggattccaggcttttagcaagaagtttctgcaagtgggagatgcctttgctgtcagctacgcagccacgctccaggctggagacctcgggaacggggagagcctcaagcttcctgcccaactcacctttcagagctcgtcacggaacagaacacagctgaaagtgcttttttccataacagcagaagaaaacgtaacggttctgccgcaccacggcctccacgcagcagggttcttcattgccttcctcctctcccttgtgctgacctgggctgccctcttcctcatggttcgctatcagtgtctgaagggaaacatgctcaccagacatcgggtttggcagtatgagagcaagctggaacccttgccgttcacctcagctgatggcgtgaatgaggacctttcccttaacgaccaaatgatagacattctgtcttccgaggaccctgggagcatgcttcaagccttagaagagttggagattgcaaccctgaatcgggcagatgcagatctggaggcttgtcgaacacaaatcagcaaggatatcattgcccttctgctgaaaaatctcaccagcagtggccacctctcaccccaagtagagagaaaaatgagtgctgttttcaaaaagcagtttctattgctggaaaatgaaatacaagaggagtacgatcggaagatggtggcattgacagctgaatgtgacctggaaacaagaaagaagatggaaaaccagtaccagagagagatgatggcaatggaggaagcagaagagttgctgaaacgtgctggtgagaggtctgctgtagagtgcagcaaccttctgcggaccctccatggcctggaacaggagcacttgaggaagtctctcgctttgcaacaagaagaagactttgccaaagctcacagacagctggctgttttccagagaaatgaactgcacagtatcttttttacccagataaaaagtgctattttcaaaggggaattgaaaccagaggcagctaaaatgctgctgcaaaattattctaaaatacaggagaatgtagaagagttaatggactttttccaggctagtaagaggtatcatctaagtaaaagatttggccacagggaatatctggtccagaacctccagtcatcagagacccgtgtgcagggccttctgagcaccgctgcagcccagctgactcacctcattcagaagcacgagagagcagggtacctggatgaagaccaaatggaaatgctattggagcgggctcagacagaagtcttttcaatcaagcagaagttggacaatgacttaaagcaggaaaagaaaaagctccaccaaaaattaataactaagagaagacgagagttgctacaaaagcacagggagcagcgtagggagcaggcgtccgtcggcgaggccttccgaacggttgaggatgccggccagtacctgcaccagaagaggagcctgatggaggagcacggtgccaccctggaggagctgcaggagcgtctggaccaggccgccctggacgatctcaggaccctgaccctttcgctgtttgaaaaggccaccgacgagctgcggcgcctgcagaactcagccatgacccaggagctgctcaagcgtggggtgccctggctcttcctgcagcagatcctggaggagcacggcaaggagatggctgcacgggccgagcagctggagggggaggagagggacagggaccaggagggtgtccagagcgtgaggcagagactgaaggatgacgctcctgaggccgtgacagaggagcaggcagagctgcgacgctgggagcacctgatcttcatgaagctctgctcctcagtcttctccctgtctgaagaggagctgctcaggatgaggcaggaggtccatggctgctttgctcagatggacaggagcttggccctccccaagatccgggcccgagttctgctgcagcaatttcagactgcgtggcgagaagcagagttcgtgaagctggaccaggccgtggctgcccctgagctgcagcaacagtccaaggtgagaaagtcacggtccaagagtaaaagcaagggagagcttctgaagaagtgcatcgaagacaaaattcacctctgtgaggaacaggcctctgaagacctggtggaaaaggttcgaggtgaattgctgcgggagagagtgcagcggatggaggcacaggagggaggctttgcacagtcgcttgttgctctgcagttccagaaggcgtcccgggtgaccgagactctgtcggcctacaccgccctcctcagcatccaggacttgctcctggaagagctgagtgcatctgagatgctgaccaagtcggcctgcacacagatcctggagtcgcacagccgggagctccaggagttggagaggaagctggaggaccagctggtgcagcaggaggcagcccagcagcagcaggccctggcgagctggcagcagtgggtggccgatgggcccgggattctgaacgaacctggggaggtggattctgaaaggcaggtctctactgtcctgcaccaagccctgagcaagagccagacattactggagcaacatcagcagtgtttgagagaggaacaacagaacagtgtcgtgctagaagacttgttggaaaacatggaggcagacacctttgcaaccctgtgcagccaggagctgagactggcatcgtacctggcgaggatggccatggtgcccggggccacgcttcgccggctcctgagtgtggtactgcccacagcctcacagcctcagctgctggccctgctggattcggccaccgagagacatgtggaccacgcagctgagagcgatggcggagcggagcaggccgacgtgggcaggcggaggaaacaccagagctggtggcaagccttagatggcaaactgcgaggagatctgataagcagaggattagaaaagatgctgtgggcccgcaagagaaagcagagcatattaaagaagacatgtctccctctcagagagaggatgatattctctggaaaaggaagttggccacacctgtcactggagcccattggcgaactggcccctgtacccattgtaggggcagaaaccattgatctattaaacacaggagagaagctctttatattcagaaatccaaaggagccagagatctcactgcacgttcctcccaggaaaaagaagaactttttgaatgccaaaaaggccatgagggccttgggcatggactagcccaagggaaagacctgcgggagcatctgaagagagaagggatgattttctcctgcccgccggtgtttgtgtgtttataatgcacaactcgcaaatataaattgcacatgcagaaggcacagaccccgtagcgcatgccaacttgcagggactcggtttaatcttgtctcatgaatttccagatggcccactctcttccatatcacaaggacataaacactccttctttcagccccacctccccagggccctggaggagacccccaccctgcaatccacaccccatcctctgctgcagaagctatggtctgtgtggtgacagccagattctctactcttatgttttgtatttgttacatattctatttttataaagggaattttaaaaaataaatgtgttttgcacaaa

SEQ ID NO: 9422 - DNA, 3795 bp, Homo sapiens
gctccagcgactcggcggcacccgccgctttgaggtagcgggtcccgacaggcgatggacccctcgggctcccgggggcgccccacgtgggtgctggccgggggtctcctggcagtggccctggcgctggggggccgaggctgtctcggcgccagctcacgtccccgctggcgccccctcggcgcgcagccaccccgggatccccaggtggctcctaggtctgggcccggcctgaggatccctccggggcggagcggggcggggcccgagagcagcacgcaggacttgccctgtatgatttggcccaaagtggaatgctgtcactttaagactgcagtggaagcaccacttggaatgaaattggacaagaaaatggaagtcttcatcccactctcaacttctgcagcctctagtgggccatgggctcattccttatttgcttttataccctcctggcctaagaagaacttatttaaaagagagtctcctataacacaccgcctgtatggggacatttcaagagaagttcaagggacttctgaaaatggagtaatttttcagaaatgtgcactggtgtctgggtcgagtgaagcacagacagcccgcatatggctgcttgttaacaacaccaagacaacctcgtcagccaacctctcggagctgctcttgctggacagcattgctggtctcaccatttgggactctgtgggaaacaggacctcggaaggattccaggcttttagcaagaagtttctgcaagtgggagatgcctttgctgtcagctacgcagccacgctccaggctggagacctcgggaacggggagagcctcaagcttcctgcccaactcacctttcagagctcgtcacggaacagaacacagctgaaagtgcttttttccataacagcagaagaaaacgtaacggttctgccgcaccacggcctccacgcagcagggttcttcattgccttcctcctctcccttgtgctgacctgggctgccctcttcctcatggttcgctatcagtgtctgaagggaaacatgctcaccagacatcgggtttggcagtatgagagcaagctggaacccttgccgttcacctcagctgatggcgtgaatgaggacctttcccttaacgaccaaatgatagacattctgtcttccgaggaccctgggagcatgcttcaagccttagaagagttggagattgcaaccctgaatcgggcagatgcagatctggaggcttgtcgaacacaaatcagcaaggatatcattgcccttctgctgaaaaatctcaccagcagtggccacctctcaccccaagtagagagaaaaatgagtgctgttttcaaaaagcagtttctattgctggaaaatgaaatacaagaggagtacgatcggaagatggtggcattgacagctgaatgtgacctggaaacaagaaagaagatggaaaaccagtaccagagagagatgatggcaatggaggaagcagaagagttgctgaaacgtgctggtgagaggtctgctgtagagtgcagcaaccttctgcggaccctccatggcctggaacaggagcacttgaggaagtctctcgctttgcaacaagaagaagactttgccaaagctcacagacagctggctgttttccagagaaatgaactgcacagtatcttttttacccagataaaaagtgctattttcaaaggggaattgaaaccagaggcagctaaaatgctgctgcaaaattattctaaaatacaggagaatgtagaagagttaatggactttttccaggctagtaagaggtatcatctaagtaaaagatttggccacagggaatatctggtccagaacctccagtcatcagagacccgtgtgcagggccttctgagcaccgctgcagcccagctgactcacctcattcagaagcacgagagagcagggtacctggatgaagaccaaatggaaatgctattggagcgggctcagacagaagtcttttcaatcaagcagaagttggacaatgacttaaagcaggaaaagaaaaagctccaccaaaaattaataactaagagaagacgagagttgctacaaaagcacagggagcagcgtagggagcaggcgtccgtcggcgaggccttccgaacggttgaggatgccggccagtacctgcaccagaagaggagcctgatggaggagcacggtgccaccctggaggagctgcaggagcgtctggaccaggccgccctggacgatctcaggaccctgaccctttcgctgtttgaaaaggccaccgacgagctgcggcgcctgcagaactcagccatgacccaggagctgctcaagcgtggggtgccctggctcttcctgcagcagatcctggaggagcacggcaaggagatggctgcacgggccgagcagctggagggggaggagagggacagggaccaggagggtgtccagagcgtgaggcagagactgaaggatgacgctcctgaggccgtgacagaggagcaggcagagctgcgacgctgggagcacctgatcttcatgaagctctgctcctcagtcttctccctgtctgaagaggagctgctcaggatgaggcaggaggtccatggctgctttgctcagatggacaggagcttggccctccccaagatccgggcccgagttctgctgcagcaatttcagactgcgtggcgagaagcagagttcgtgaagctggaccaggccgtggctgcccctgagctgcagcaacagtccaaggtgagaaagtcacggtccaagagtaaaagcaagggagagcttctgaagaagtgcatcgaagacaaaattcacctctgtgaggaacaggcctctgaagacctggtggaaaaggttcgaggtgaattgctgcgggagagagtgcagcggatggaggcacaggagggaggctttgcacagtcgcttgttgctctgcagttccagaaggcgtcccgggtgaccgagactctgtcggcctacaccgccctcctcagcatccaggacttgctcctggaagagctgagtgcatctgagatgctgaccaagtcggcctgcacacagatcctggagtcgcacagccgggagctccaggagttggagaggaagctggaggaccagctggtgcagcaggaggcagcccagcagcagcaggccctggcgagctggcagcagtgggtggccgatgggcccgggattctgaacgaacctggggaggtggattctgaaaggcaggtctctactgtcctgcaccaagccctgagcaagagccagacattactggagcaacatcagcagtgtttgagagaggaacaacagaacagtgtcgtgctagaagacttgttggaaaacatggaggcagacacctttgcaaccctgtgcagccaggagctgagactggcatcgtacctggcgaggatggccatggtgcccggggccacgcttcgccggctcctgagtgtggtactgcccacagcctcacagcctcagctgctggccctgctggattcggccaccgagagacatgtggaccacgcagctgagagcgatggcggagcggagcaggccgacgtgggcaggcggaggaaacaccagagctggtggcaagccttagatggcaaactgcgaggagatctgataagcagaggattagaaaagatgctgtgggcccgcaagagaaagcagaggtcagggaaccaagagagcttctggcagtacctggtagggactccagagattgggttaattgagtggatgtctgaaaaatga

SEQ ID NO: 9423 - DNA, 4409 bp, Homo sapiens
ctcgctccctgacttccgggtcgcggtgcttgaagggagtgttccgtcgtttccgttgccggctgtttgcagtggggaaaccgaggcagctcctgctccccctagttcttccgctcctgtgaggaaaaaaaaatgtttatttctttgtgggagttcttctatgggcacttttttcgattttggatgaaatggctattacgacagatgactgggaagtgtgaattgcagcgaatatttgatacctatgtaggtgcacaaaggacacacaggatagaaaattccttgacatactccaagaataaggttttacagaaggcgacacatgttgttcagagtgaagtggacaaatatgtagatgatattatgaaggaaaagaatattaaccctgagaaggatgccagttttaaaatatgcatgaagatgtgcttactgcagataactggttataaacagctgtatttggatgtagaaagtgtgaggaaaaggccatatgattctgataacctacagcatgaagagctactcatgaagctttggaatcttctaatgcccacgaagaagttaaacgctagaatctccaagcagtgggctgaaattggttttcagggtgatgatcccaagacagacttcagaggcatgggcatacttgggttaatcaatcttgtgtatttcagtgaaaattacactagtgaagctcatcagattctttcccgttcaaatcatccaaaattagggtattcttatgcaatagttggaatcaatcttacagagatggcttatagcttactgaagagtgaagctttgaagtttcatctctataaccttgttcctggtataccaacaatggaacactttcatcagttttactgttatcttgtctatgaatttgacaagttttggtttgaagaagaaccagaaagcattatgtatttcaatttgtatagagagaagtttcatgaaaagattaaaggacttttactggattgtaatgtagcacttactttaaaagtataaatcatccactgtatcttctatttctaccacattttgcacattcaacagaatttatatgttgtaataggaattatctgatcaattacactcttatatataatttcctacaaaaatatttcagaaattctatttaagaaagctagtggacaatcagtgtatgtttacaattgtttatacactgttctccaaaggtaccttatccttccaaagatcccctctgtagagtcatgcgaactacagtttggaacttgggacttagcccgttggtgtaaaagtataaatcaggtatttgtattaaattgattaaaatgtgtaaaatcaattttcgtttttatgtgttatagggtcaagttggtatctttttcaaagctctttaagatttttttggtttttagtttggaaatggctgtttttaattttgtctgatttttatttctaggttaattaacagcaagtgtttctttatggttttctttgtttgcatcttaattacatgtcataacgttgcttcattagtagcaaatagagcagagatacagcagagagaataaagaattagggcctccttttgggtttctgtgattattgagcataactgatgagagaatgacagtattggtgactagcttttttgtttttaaataacacactttaaaatgccacagtgttatttgaaagcttaaaggcattttctcatcttcagtatttgctttttatcagttgtagaaaagaaccttagtgttttcttctctacctatgtatgcttatgaaaccgctctacctacatatgaaacttctctacctatgtatgtttacgaaaagagatgtatttgccaagaaaatcttgattatataaaagacaaaaagattataaaagacagtttctgtttaagtaaaactgtctttgaaacttaagaaagcttaagttttaaaaaaatctcagttaaacatcattggtttatttgacttactgttaactcttgcttctctttgactccatggtgtttttagataaccatgtatgaactttatgttaatggtttgtgggatactaaaatagcttgaagatgacttgatgactgtgcattttatatagttttattctcctaaaatctcaggagggcagcaagtgctgtcaacgattatatagtgatgagatttttatgggaatgatttcttcttggtgcgttttacacatttgtactgatagcaaaactaaagtttaaagcagcaaagtttaagttctccttaaatcctacagaaaccaaccttttaaggacataatttcatctaaaacatgacgatatttagcacaccttttaatgtgggtatatatcaagtgtttaaggactggctagtatgtgatagagcaagacctgagactttataagtatttgctcgtgtctgttgacagacctctttctttcaaacttgttagaagagtggtaagacatatccaattggaaaataagatgcagtgttgtatagcacatacatttaaagtgcttgcgttaaaattagtttctcaataagataaaattattttaaaaatttggttcactttattacaatagtggcaatttagcttttcagtattacaggaatttaaaaattggtttcttgtaggggacatctcaactttgggaatatcttcacttaatttttaaaaaatattttcatgctttattgtccagctatacaatatgtcgcaaaatcctgacaagttcattgtattaaggtattaactattacatggaaagcaattctgttcatcttttgatgtttgtgttgaaaatgcttatctttgtgttttgatcttccaacagctgagagcttgaactgatttaaacatttgtcaatatacttaagaatgctttaagtaaagaaggggaaaattttaagtaagttttttcccttctaggaagaaaaactatgatgatgttaagaaaatgtcattatagagcttgctcaataatatgttctttaaatccacctccatttgtacattataggtatcattctgtttttgcttaaaataatctgcaaccatttcagatagttttacagcaaattgatctaaaagccactaataaattctagggtttgagtctagaagccaagcaaactgtcaccaatgtcagttgtaaattagaatgcaacatgaggcttcagactcatgacaatgatatacatgaaaacaaaaatataattgtgtctaccttcctactttcccttttgacatatgtagttggaattttacatagtcttaaaatccatatttagaatcttacctgtttctataataattagtaaaatgccaaagtagtgatagaatattgtggcattgaagtagccgaaaaattgttagttttagcatcaaaaaagtaaatagatgttgaaatgaatttttgtatgtgccaggttgaagagagtgtgccagtgacaggaagtagtctaaaaaattaacagttatggttttaataggatctgaaagacaatctttaaagaaatgggagaaattgggggtatcagtgaacctataccaacctctctttgtacataaatatggtgatgtagctagatataaaaatcagtgtcttactggcaccatttacagtttagaaaacaatctttttcttaaaaatgcccatctgatttctatttttaggagctacttggatttgtatgtattttttctacgtgaaaatatatgtactcttcacttttgttccagtactataattgctcatgcactctttctcccctttgagaacattcagtgaaatacaacttcatcaaagatttgctcaaaggagaagaatcgcatgagtgtgaaaagtagatgctcgtagccagaacagaaaaggttacacatgatcatggcacagaagataggaggtttgacttggtgggccataatgtttattatcctttttgaaataacagggaccagcagcagttttctcaggataaatgctctaccccacttctctatgaacaggtgtggggaggcttactttccattttcatatttatacacctctctacaaaagcaatttttaatgaaggttagtggaattgttaaaaatctgagaggaatgatgactggaggtgtttggggtttttttctgtattcattttttaatgagaaaagttttaaatgtagtacaggttagacccaactactaccttactattataggacgattctatgtttctgttaaagtattcaagtagctttctctgggggaaaaagtaccacttggacacttaaaggaattgggatttttgtctactttggataaggcagttgacttcttaagtaaaagcaatagtgtaaaatgtcattttgtttggaatgttaagtgagcaaataaaaaacatgttgaaattgt

SEQ ID NO: 9424 - DNA, 738 bp, Homo sapiens
gcgcgaggggggtcggcgcagagacgcccagagccctggggtgctcaggcgccgctacgcgtgcatcccctctgctcggcagttctgcgcttttgtcctaatgagcgcggactagatggcttgattttcaagataatgatcaacccagctgtgctatgcgctctttctgcactgacctgcgggtacttcgaacttcgacagtccctcctcaggccctagtccagaggaaaaaaaaatgtttatttctttgtgggagttcttctatgggcacttttttcgattttggatgaaatggctattacgacagatgactgggaagtgtgaattgcagcgaatatttgatacctatgtaggtgcacaaaggacacacaggatagaaaattccttgacatactccaagaataaggttttacagaaggcgacacatgttgttcagagtgaagtggacaaatatgtagatgatattatgaaggaaaagaatattaaccctgagaaggatgccagttttaaaatatgcatgaagatgtgcttactgcagataactggttataaacagctgtatttggatgtagaaagtgtgaggaaaaggccatatgattctgataacctacagcatgaagagctactcatgaagctttggaatcttctaatgcccacgaagaagttaaacgctagaatctccaagcagtgggctgaaattggttttcagggtgatgatcccaagacagacttcagagg

SEQ ID NO: 9425 - DNA, 594 bp, Homo sapiens
ggtgcttgaagggagtgttccgtcgtttccgttgccggctgtttgcagtggggaaaccgaggcagctcctgctccccctagttcttccgctcctgtgaggtggctgctgtttcttttcctcttgccccggatgcctcggtgcggctgcactgagagcgcgcgggctcgcgagccccgcggggttctgcgggaacccgggggcgcctgggccggcgggtctttgtgcgagccctgccctcccattcgcgggcggcgcgcgaggggggtcggcgcagagacgcccagagccctggggtgctcaggcgccgctacgcgtgcatcccctctgctcggcagttctgcgcttttgtcctaatgagcgcggactagatggcttgattttcaagataatgatcaacccagctgtgctatgcgctctttctgcactgacctgcgggtacttcgaacttcgacagtccctcctcaggccctagtccagaggaaaaaaaaatgtttatttctttgtgggagttcttctatgggcacttttttcgattttggatgaaatggctattacgacagatgactgggaagtgtgaattgcagcgaatattt

SEQ ID NO: 9426 - DNA, 4025 bp, Homo sapiens
ggcggggcggggcgtggccggcgtggcggcgctggagccgggaagggggcgcgggggagagatggtcgcaagatggcggcgctgaaggaggataggagctacgggctgtcgtgcgggcgggttagcgacggcagcaaggtgtcggtgttccacgtgaagctcaccgacagtgccctgagggccttcgagagctaccgcgccagacaggattctgtttcactgaggccatctatccgatttcaaggaagccaagggcacatctccatcccccagcctgactgccccgcagaggcgcggacgttctccttctacctctccaacatcggccgcgacaacccccagggcagcttcgactgcatccagcagtatgtctccagtcatggggaagttcacctggactgcctgggcagcatacaggacaagatcacggtgtgtgccaccgacgactcctaccagaaggcgcggcagagcatggcccaggcggaggaggagacgcggagccgaagtgccattgtcatcaaggctggaggccgctacctgggcaagaaggttcagtttcggaaaccagccccaggtgcaacagacgcggtgccctcccggaagcgggcaacccccatcaacttggcgagtgccatcaggaagagtggtgccagtgccgtgagtgggggcagcggggtgtcccagaggcccttccgtgaccgagtgctgcacctcctggcactacggccctaccgcaaggctgagctgctgctgcgactgcagaaggacggcctgacgcaggcggacaaggacgcgctggatggcctcctccagcaggtggccaacatgagtgctaaggacggcacgtgtacactgcaggactgcatgtacaaggatgtgcagaaggactggcctggctactcggagggggaccagcagctgctgaagcgggtgctcgtccggaagctgtgccagccacagagcactggcagcctccttggagaccctgctgcctccagccccccaggcgagcgtgggcgctcggcctcgcccccacagaagcggctgcagcctcctgatttcatcgaccccctagccaacaagaaaccccggatatcgcacttcactcagagagctcagcctgccgtcaacgggaagctgggcgtgcccaatggccgtgaggccttgctgcccaccccgggcccaccagccagcacggacaccctcagctccagcactcacctgcccccgcggctggagcccccgagggcccacgaccccctggccgatgtcagcaatgacctgggccacagcggccgagactgtgagcacggagaggcggctgccccagcccccactgtgcgcctcggcctgcccctgctgacggactgtgcccagcccagcaggccacacggcagcccctcgcgcagcaagcccaagaagaagtccaagaagcacaaagacaaggagagggcggctgaggacaagccccgggcccagcttccagactgtgcacctgccacccatgccacccccggagccccagcagacaccccaggtttaaacggaacctgcagcgtttccagtgttcccacgtccacgtcggagacgcctgactacttgctgaagtacgcagccatctcctcttcggagcagcgccagagctacaagaacgacttcaatgccgagtacagcgagtaccgcgacctgcacgcccgcattgagcgcatcacgcggcggttcacccagctcgacgcccagctccggcagctctcccagggctccgaggagtatgagactactcgagggcagattttgcaggaatatcgaaaaatcaaaaagaccaacaccaactacagccaggagaagcaccgctgcgagtacctgcacagcaagctggcccacatcaagaggctcatcgccgagtacgaccagcggcagctgcaggcttggccctagccgccctccccgatggcggggatctgggagggtcgggggagcaaaaggcggtgagagaggatttatttaaaaaaataaacccgaggaagatgctcatctgagccagcaccgccggctttcagggcagcccctgcagacgtctggccctggcgggtggctgcaagcccacctcggccctccctgcgcttcctgagcagtccctgcttatgatgggctccccaggaagcccactgcctcctccctggctgcagcctccggggttcagcctcctgtctcgccagaagactcctaggcccttggggtggcgcgcctgccttttctagttttatacaaagacagccacttttagctactgctaatgagacttgagtctatttttgtacaaaagagaagcaaaatcttttttctaaacctgtgcctccctctcctcggacacccagggtctagccgctgccctgggtcctgcctgcagtattacagaggtcgtcgaaaggtgcagctgcgttctgagggcgtggggaatgggcaggtggcctctgctggtctctggctctacgtttaggcacccctttccccagcctctcctccttgggcagggtctctgctccagcaagcaaacagggtggcccaggtggctattttgagaactccagctggtgcccccagacagctgctcagagccaagggggcagagggctttcagcgcccccaggcctgccctgctatttcaggccctcagctgtcgggggccactgtgtttctgtgctccaagttgagactcggccgcagcggcgtcagacttttctttgcgatgtcctcggtttcccatttgttgctgctgctgctcattccacactgttgagaccttgtggtctcgatgctgctggcctccctccgtccctctgtccacttgtgggtcctggggtcgtcttagcagagccaccgccaaggtttgcactcagggaggggctgatggagggctgggcgccatggggtcagggaggccccagggacccatgggcagagctggggagccaggaggatgggtctgcctgctctgggggtgcaggctctgcagacaccccaattgctgctctgttgctgtgcctagtctagtgtcccccaaagcatcggggggccacgcaagtgtgggtgtgtgagtgtgcgtatgtggggaccccccagggcatggtggggtctgaggcgtgtgttcccatttagggctgaatgaagccatgacttggaaaggtggtggggggtggatggcggctgtgactcagggcccagggatcacatgggggtcactgctgccatcagcagtcaggcagggagaacagaaatgcaaaaatacagatgtctatttttctaaactggggggtggaggggtgcctcctgacagcttccaaagagctgactgtggagggcccacagtgtatcccacccctgcccgagagtctctctcctttgggacccccgggttcccagagctccgaggaaactgatccttcatgtttcaatagctgttgttgtttttctctttgggccgggccgggccggggaagggccgagcaggctccaggaggcctccagagtcagctggaccttgctgtgtcgcccgcaggcagccctgcagacaccggtgaggtgggatgatttcaggaggtcccagcccgggactgcccgcccctctgccctgggaaccagtccaaggggctgtcagttgaatttgcctttttgttgttgttgttgtttttgttgtttatttgttctccttttaaggaattatgaagctaagaaaagttttgtgttttgggggttggtggacaaagttctagctgattaaatatggtctaacttattgatactatttttttttcttttaatgttgtactgtggagaaaaactattttgagccatggggttggtgtttacaagaactttccacttttgccaaaatgttacaattgaaaggcatctatctgcgtcttcagtttcctgatattttcttaaaagatctagtgtcctttttgtacactaaacaggtgaatgctgacttttttcattctccaataaatttcactgaactg

SEQ ID NO: 9427 - DNA, 87 bp, Homo sapiens
attcacaggctggtggtggctttccaagattctgtttcactgaggccatctatccgatttcaaggaagccaaggggagatgagtctc

SEQ ID NO: 9428 - DNA, 2352 bp, Homo sapiens
aactttcactgctgccaccacaaccgcagggccccaattacctctctgttagaaatcggtttcagagcggtggaaccgcgggcgggaaaaagcccaggcgctgtctcgggtgccccttcgtgtcagccatcctctggtctctcgggtctccgaagctcggggctaactgggcgcgaaccgctgagcccgcctaccaaccaggccctttctcccgcccctctgcggctgaaaccctcaaggggttgcaggttcagctttcacttagagacagcaactccaaattcagggtcgctggggaaactaaggcaggactggggactctgagtgagaggtcagacgctggtcgcggactctttctcccgagaactggggatagctcttccgatagcccaaagcgattcatgcggatcctagaagaaagcgccgaggtccgggcggttggccggggagagcgaagcgccgcccacgcggctgggaaagcttggggtggcgctggcgggaggtggggccgggggcgggttcctggcggagggtggggcagacgtgggttaccgggtgtgccaaccaaaccctgaacagaggaggtggcggtggtggccctcgcctgtggcccccgtgctgcttgcactcgaactcgtcgccatggaggagctccaggagcctctgagaggacagctccggctctgcttcacgcaagctgcccggactagcctcttactgctcaggctcaacgacgctgccctgcgggcgctgcaagagtgtcagcggcaacaggtacggccggtgattgctttccaaggccaccgagggtatctgagactcccaggccctggttggtcctgcctcttctccttcatagtgtcccagtgttgtcaggagggcgctggtggtagcttggaccttgtgtgccaacgcttcctcaggtctgggcctaacagcctccactgcctgggctcactcagggagcgcctcattatttgggcagccatggattctatcccagccccatcatcagttcagggacacaacctgactgaagatgccagacatcctgagagttggcagaacacaggaggctattctgaaggagatgcagtatcacagccacagatggcactagaggaggtgtcagtgtcagatccactggcaagcaaccaaggacagtcactcccaggatcctcaagggagcacatggcacagtgggaagtgagaagccagacccatgttccaaacagagaacctgttcaggcactgccttcctctgccagccggaaacgtctggacaagaaacgttcagtgcctgtagccactgtagaactggaagaaaagaggttcagaactctgcctttagtgccaagccccctacaaggcctgaccaatcaggatttacaagagggagaagattgggagcaagaagatgaggacatggaccccagattagaacacagttcctcagttcaagaagattctgaatccccaagtcctgaagatataccagactacctcctgcaatacagggccatccacagtgcagaacagcaacatgcctatgagcaggactttgagacagattatgctgaataccgcatcctgcatgcccgtgttgggactgcaagccaaaggttcatagagctgggagcagagattaaaagagttcggcgaggaactccagaatacaaggtcctggaagacaagataatccaggaatataaaaagttcaggaagcagtacccaagttacagagaagaaaagcgtcgctgtgagtaccttcaccagaaattgtcccacattaaaggtctcatcctggagtttgaggaaaagaacaggggcagctgaagttatcaagggaatttttgagcctctgcttagtgaaacacaaaggaacaaagcagctataaactaaatagaatgcaactatctgcttttcttatgctgaccactggagtccatggtggcaagtagagagctgctctaggttcttgaggtttggttttcattattaatttttagggtatgggcactgtgcaaagactccatagctgtgcctaggagtctaggaaaagtgacagaggcttggcttttttacctttagttcagccaagtcattttcaagtcctgagaaatgacatcatcttcaggataaaataatgaggacattagacaaaccaaactaagtgaattttagcctggtagcctctctaaggaaacagtaataataacttctgataagagttaaaagaacttgtagcatacctggatataatgggaaagggcctgggtgttacccatgtactgaaaatgaacttttaccaacatggctaaaaaattaaaactgactgcttctgtgtcctt

SEQ ID NO: 9429 - DNA, 3973 bp, Homo sapiens
cttcctggcggcgggcgcaggcgtttcctcggcgtggggcggaagcacgatctccggcagcggcctgggaactcttagctgagcaggcgagagcatcatggataccgacttatatgatgagtttgggaattatattggaccagagcttgattctgatgaagatgatgatgaattgggtagagagaccaaagatcttgatgagatggatgatgatgacgacgacgatgacgtaggagatcatgacgatgaccaccctgggatggaggtggtgctgcatgaggtgtatggtcctgaggtggagaccatagttcaagaggaagacactcagcctctcacagaacccattattaagccagtgaaaaccaagaaattcactctgatggagcagacattacctgttacggtgtatgagatggatttcttggcggatctgatggataactcagagctcatcagaaatgtgaccctttgtggacatctccaccatggcaagacatgttttgtggattgtttaattgaacagactcacccggaaatcagaaagcgctatgaccaagatctgtgctatactgacatcctcttcacagagcaagagagaggtgtaggcatcaaaagcactcctgtgacagtggtcttgccagacaccaaaggaaaatcttatctcttcaatatcatggacactccaggacatgtgaatttctctgatgaggtcacagctggcttgcgcatctcagatggagtggtccttttcattgatgctgctgagggggtgatgctgaacacagagcggctgatcaagcatgcggtgcaggagaggctggcagtcactgtgtgcatcaacaagattgaccggctgatcctggagctgaagctgcctccaactgatgcttattacaagctgcgccacattgtggatgaggtcaatggattaataagcatgtattccactgatgagaacctgatcctttccccactcctgggtaacgtctgcttctccagctcccagtacagcatctgcttcacgctgggctcctttgccaagatctatgccgacacctttggtgacattaattaccaagaatttgctaaaagactctggggtgacatctacttcaaccctaagacgcgaaagttcaccaaaaaggccccaactagcagctcccagagaagtttcgtggagtttatcttggagcctctttataagatcctcgcccaggttgtaggtgacgtggacaccagcctcccacggaccctagacgagcttggcatccacctgacgaaggaggagctgaagctgaacatccgccccttgctcaggctggtctgcaaaaagttctttggcgagttcacaggctttgtggacatgtgtgtgcagcatatcccttctccaaaggtgggcgccaagcccaagattgagcacacctacaccggtggtgtggactccgacctcggcgaggctatgagtgactgtgaccctgatggccccctgatgtgccacactactaagatgtacagcacagatgatggagtccagtttcacgcctttggccgggtgctgagtggcaccattcatgctgggcagcctgtgaaggtactgggggagaactacaccctggaggatgaggaagactcccagatatgcaccgtgggccgcctttggatctctgtggccaggtaccacatcgaggtgaaccgtgttcctgctggcaactgggttctgattgaaggtgttgatcaaccaattgtgaagacagcaaccataaccgaaccccgaggcaatgaggaggctcagattttccgacccttgaagttcaataccacatctgttatcaagattgctgtggagccagtcaacccctcagagctgcccaagatgcttgatggcctgcgcaaggtcaacaagagctatccatccctcaccaccaaggtggaggagtctggcgagcatgtgatcctgggcactggggagctctacctggactgtgtgatgcatgatttgcggaagatgtactcagagatagacatcaaggtggctgacccagttgtcacgttttgtgagacggtggtggaaacatcctccctcaagtgctttgctgaaacgcctaataagaagaacaagatcaccatgattgctgagcctcttgagaagggcctggcagaggacatagagaatgaggtggtccagattacgtggaacaggaagaagctgggagagttcttccagaccaagtacgattgggatctgctggctgcccgttccatctgggcttttggccctgatgcgactggccccaacattctggtggatgatactctgccctctgaggtggacaaggctcttcttggttcagtgaaggacagcatcgttcaaggtttccagtggggaaccagggagggccccctctgtgatgaattgattcggaatgtcaagtttaagatcctggatgcggtggttgcccaggagcccctgcaccggggcgggggccagatcatccccacagccaggagagtcgtctactctgccttcctcatggctactcctcgtctgatggagccttactactttgtagaggtccaggcccctgcagattgcgtctctgcagtttataccgtcctggccaggcgcagggggcacgtgactcaggatgcacccatcccaggctcccctctgtacaccatcaaagcttttatcccggccatcgactcttttggctttgagactgatctccggactcacacccagggacaagccttttctctgtctgtcttccaccactggcagattgtgcctggtgatcccctggacaagagcattgtcatccgccccttggagccacagccagctcctcacctggcccgggaattcatgatcaaaacccgccgtaggaagggcctcagtgaagatgtgagcatcagcaaattcttcgatgatcctatgttgctggaacttgccaaacaggatgttgtgctcaattaccccatgtgagtgcgtggactcctgggagctcctgctccctacagtgggctgcaactcctgtacttgaagctgagacctcatatgacgtggccttcgtgttgtcagagagtgtctggaagctgctgttgccatcttgaacaactcaccaacctccaacccagagccccagtgagagaggagcatttggcctcctgcttccttctgtggcctctgccgggctccattcccaaggaaaagagaggagcttgggctcacagaaagagaaggggatgaaaccccaaggggccctatctttgggatttacatggaattttattttctacaagtttgaccttagccatggtttgcaagtgaacagaacattctgacctctgtcttgctctgctcctttcatcctcgtctcccctgccccgtctggtgcttacattctgaatatatgtcatctcccaagaggcttcactgcctctgcttccagctgcagcctccttcctgcctgggtccccagggaagccgcctgccttttaattcagtgttcccatgagcgccaaggccccattattgcccccttgctcccactccatgctgcttctgggtggaacctaagatggcttgggagttgttgggttcctgcgatcagaagtctaccccaccacctcctcaggaaactgctgcctcccctaagaatcttccttgccctggagtagggggccagagcactttgatttccagccatttactccaagtcctctccccagctaccaccagtcccttactctgttctcccccagtgaaaaagagtctgttgattttcctcaaaactgctttattaggaatgtaccagggattgagttaggggagttggacagccccggctcctataggagtcctacttctctccagcatcctgtgccatcctcttgacgtaatcgctgtacattgtgtacacagcacctgtgtgagagaaaagaaataatgccccttggcatcaaacccttc

SEQ ID NO: 9430 - DNA, 4058 bp, Homo sapiens
atcctcagctctcaccctctttggagcagcccacgtcttgggctactcgtcttggggacccgctactccgccttgccagtccgcggcgggcatacctcggaactggtcctcaggcagagggttgtcctcccgggcagaaaggcgacagcggcgtctgcggggtccttcctggcggcgggcgcaggcgtttcctcggcgtggggcggaagcacgatctccggcagcggcctgggaactcttagctgagcaggcgagagatggatgatgatgacgacgacgatgacgtaggagatcatgacgatgaccaccctgggatggaggtggtgctgcatgaggacaagaagtactacccaacagccgaggaggtgtatggtcctgaggtggagaccatagttcaagaggaagacactcagcctctcacagaacccattattaagccagtgaaaaccaagaaattcactctgatggagcagacattacctgttacggtgtatgagatggatttcttggcggatctgatggataactcagagctcatcagaaatgtgaccctttgtggacatctccaccatggcaagacatgttttgtggattgtttaattgaacagactcacccggaaatcagaaagcgctatgaccaagatctgtgctatactgacatcctcttcacagagcaagagagaggtgtaggcatcaaaagcactcctgtgacagtggtcttgccagacaccaaaggaaaatcttatctcttcaatatcatggacactccaggacatgtgaatttctctgatgaggtcacagctggcttgcgcatctcagatggagtggtccttttcattgatgctgctgagggggtgatgctgaacacagagcggctgatcaagcatgcggtgcaggagaggctggcagtcactgtgtgcatcaacaagattgaccggctgatcctggagctgaagctgcctccaactgatgcttattacaagctgcgccacattgtggatgaggtcaatggattaataagcatgtattccactgatgagaacctgatcctttccccactcctgggtaacgtctgcttctccagctcccagtacagcatctgcttcacgctgggctcctttgccaagatctatgccgacacctttggtgacattaattaccaagaatttgctaaaagactctggggtgacatctacttcaaccctaagacgcgaaagttcaccaaaaaggccccaactagcagctcccagagaagtttcgtggagtttatcttggagcctctttataagatcctcgcccaggttgtaggtgacgtggacaccagcctcccacggaccctagacgagcttggcatccacctgacgaaggaggagctgaagctgaacatccgccccttgctcaggctggtctgcaaaaagttctttggcgagttcacaggctttgtggacatgtgtgtgcagcatatcccttctccaaaggtgggcgccaagcccaagattgagcacacctacaccggtggtgtggactccgacctcggcgaggctatgagtgactgtgaccctgatggccccctgatgtgccacactactaagatgtacagcacagatgatggagtccagtttcacgcctttggccgggtgctgagtggcaccattcatgctgggcagcctgtgaaggtactgggggagaactacaccctggaggatgaggaagactcccagatatgcaccgtgggccgcctttggatctctgtggccaggtaccacatcgaggtgaaccgtgttcctgctggcaactgggttctgattgaaggtgttgatcaaccaattgtgaagacagcaaccataaccgaaccccgaggcaatgaggaggctcagattttccgacccttgaagttcaataccacatctgttatcaagattgctgtggagccagtcaacccctcagagctgcccaagatgcttgatggcctgcgcaaggtcaacaagagctatccatccctcaccaccaaggtggaggagtctggcgagcatgtgatcctgggcactggggagctctacctggactgtgtgatgcatgatttgcggaagatgtactcagagatagacatcaaggtggctgacccagttgtcacgttttgtgagacggtggtggaaacatcctccctcaagtgctttgctgaaacgcctaataagaagaacaagatcaccatgattgctgagcctcttgagaagggcctggcagaggacatagagaatgaggtggtccagattacgtggaacaggaagaagctgggagagttcttccagaccaagtacgattgggatctgctggctgcccgttccatctgggcttttggccctgatgcgactggccccaacattctggtggatgatactctgccctctgaggtggacaaggctcttcttggttcagtgaaggacagcatcgttcaaggtttccagtggggaaccagggagggccccctctgtgatgaattgattcggaatgtcaagtttaagatcctggatgcggtggttgcccaggagcccctgcaccggggcgggggccagatcatccccacagccaggagagtcgtctactctgccttcctcatggctactcctcgtctgatggagccttactactttgtagaggtccaggcccctgcagattgcgtctctgcagtttataccgtcctggccaggcgcagggggcacgtgactcaggatgcacccatcccaggctcccctctgtacaccatcaaagcttttatcccggccatcgactcttttggctttgagactgatctccggactcacacccagggacaagccttttctctgtctgtcttccaccactggcagattgtgcctggtgatcccctggacaagagcattgtcatccgccccttggagccacagccagctcctcacctggcccgggaattcatgatcaaaacccgccgtaggaagggcctcagtgaagatgtgagcatcagcaaattcttcgatgatcctatgttgctggaacttgccaaacaggatgttgtgctcaattaccccatgtgagtgcgtggactcctgggagctcctgctccctacagtgggctgcaactcctgtacttgaagctgagacctcatatgacgtggccttcgtgttgtcagagagtgtctggaagctgctgttgccatcttgaacaactcaccaacctccaacccagagccccagtgagagaggagcatttggcctcctgcttccttctgtggcctctgccgggctccattcccaaggaaaagagaggagcttgggctcacagaaagagaaggggatgaaaccccaaggggccctatctttgggatttacatggaattttattttctacaagtttgaccttagccatggtttgcaagtgaacagaacattctgacctctgtcttgctctgctcctttcatcctcgtctcccctgccccgtctggtgcttacattctgaatatatgtcatctcccaagaggcttcactgcctctgcttccagctgcagcctccttcctgcctgggtccccagggaagccgcctgccttttaattcagtgttcccatgagcgccaaggccccattattgcccccttgctcccactccatgctgcttctgggtggaacctaagatggcttgggagttgttgggttcctgcgatcagaagtctaccccaccacctcctcaggaaactgctgcctcccctaagaatcttccttgccctggagtagggggccagagcactttgatttccagccatttactccaagtcctctccccagctaccaccagtcccttactctgttctcccccagtgaaaaagagtctgttgattttcctcaaaactgctttattaggaatgtaccagggattgagttaggggagttggacagccccggctcctataggagtcctacttctctccagcatcctgtgccatcctcttgacgtaatcgctgtacattgtgtacacagcacctgtgtgagagaaaagaaataatgccccttggcatcaaacccttc

SEQ ID NO: 9431 - DNA, 4167 bp, Homo sapiens
atcctcagctctcaccctctttggagcagcccacgtcttgggctactcgtcttggggacccgctactccgccttgccagtccgcggcgggcatacctcggaactggtcctcaggcagagggttgtcctcccgggcagaaaggcgacagcggcgtctgcggggtccttcctggcggcgggcgcaggcgtttcctcggcgtggggcggaagcacgatctccggcagcggcctgggaactcttagctgagcaggcgagagcatcatggataccgacttatatgatgagtttgggaattatattggaccagagcttgattctgatgaagatgatgatgaattgggtagagagaccaaagatcttgatgagatggatgatgatgacgacgacgatgacgtaggagatcatgacgatgaccaccctgggatggaggtggtgctgcatgaggacaagaagtactacccaacagccgaggaggtgtatggtcctgaggtggagaccatagttcaagaggaagacactcagcctctcacagaacccattattaagccagtgaaaaccaagaaattcactctgatggagcagacattacctgttacggtgtatgagatggatttcttggcggatctgatggataactcagagctcatcagaaatgtgaccctttgtggacatctccaccatggcaagacatgttttgtggattgtttaattgaacagactcacccggaaatcagaaagcgctatgaccaagatctgtgctatactgacatcctcttcacagagcaagagagaggtgtaggcatcaaaagcactcctgtgacagtggtcttgccagacaccaaaggaaaatcttatctcttcaatatcatggacactccaggacatgtgaatttctctgatgaggtcacagctggcttgcgcatctcagatggagtggtccttttcattgatgctgctgagggggtgatgctgaacacagagcggctgatcaagcatgcggtgcaggagaggctggcagtcactgtgtgcatcaacaagattgaccggctgatcctggagctgaagctgcctccaactgatgcttattacaagctgcgccacattgtggatgaggtcaatggattaataagcatgtattccactgatgagaacctgatcctttccccactcctgggtaacgtctgcttctccagctcccagtacagcatctgcttcacgctgggctcctttgccaagatctatgccgacacctttggtgacattaattaccaagaatttgctaaaagactctggggtgacatctacttcaaccctaagacgcgaaagttcaccaaaaaggccccaactagcagctcccagagaagtttcgtggagtttatcttggagcctctttataagatcctcgcccaggttgtaggtgacgtggacaccagcctcccacggaccctagacgagcttggcatccacctgacgaaggaggagctgaagctgaacatccgccccttgctcaggctggtctgcaaaaagttctttggcgagttcacaggctttgtggacatgtgtgtgcagcatatcccttctccaaaggtgggcgccaagcccaagattgagcacacctacaccggtggtgtggactccgacctcggcgaggctatgagtgactgtgaccctgatggccccctgatgtgccacactactaagatgtacagcacagatgatggagtccagtttcacgcctttggccgggtgctgagtggcaccattcatgctgggcagcctgtgaaggtactgggggagaactacaccctggaggatgaggaagactcccagatatgcaccgtgggccgcctttggatctctgtggccaggtaccacatcgaggtgaaccgtgttcctgctggcaactgggttctgattgaaggtgttgatcaaccaattgtgaagacagcaaccataaccgaaccccgaggcaatgaggaggctcagattttccgacccttgaagttcaataccacatctgttatcaagattgctgtggagccagtcaacccctcagagctgcccaagatgcttgatggcctgcgcaaggtcaacaagagctatccatccctcaccaccaaggtggaggagtctggcgagcatgtgatcctgggcactggggagctctacctggactgtgtgatgcatgatttgcggaagatgtactcagagatagacatcaaggtggctgacccagttgtcacgttttgtgagacggtggtggaaacatcctccctcaagtgctttgctgaaacgcctaataagaagaacaagatcaccatgattgctgagcctcttgagaagggcctggcagaggacatagagaatgaggtggtccagattacgtggaacaggaagaagctgggagagttcttccagaccaagtacgattgggatctgctggctgcccgttccatctgggcttttggccctgatgcgactggccccaacattctggtggatgatactctgccctctgaggtggacaaggctcttcttggttcagtgaaggacagcatcgttcaaggtttccagtggggaaccagggagggccccctctgtgatgaattgattcggaatgtcaagtttaagatcctggatgcggtggttgcccaggagcccctgcaccggggcgggggccagatcatccccacagccaggagagtcgtctactctgccttcctcatggctactcctcgtctgatggagccttactactttgtagaggtccaggcccctgcagattgcgtctctgcagtttataccgtcctggccaggcgcagggggcacgtgactcaggatgcacccatcccaggctcccctctgtacaccatcaaagcttttatcccggccatcgactcttttggctttgagactgatctccggactcacacccagggacaagccttttctctgtctgtcttccaccactggcagattgtgcctggtgatcccctggacaagagcattgtcatccgccccttggagccacagccagctcctcacctggcccgggaattcatgatcaaaacccgccgtaggaagggcctcagtgaagatgtgagcatcagcaaattcttcgatgatcctatgttgctggaacttgccaaacaggatgttgtgctcaattaccccatgtgagtgcgtggactcctgggagctcctgctccctacagtgggctgcaactcctgtacttgaagctgagacctcatatgacgtggccttcgtgttgtcagagagtgtctggaagctgctgttgccatcttgaacaactcaccaacctccaacccagagccccagtgagagaggagcatttggcctcctgcttccttctgtggcctctgccgggctccattcccaaggaaaagagaggagcttgggctcacagaaagagaaggggatgaaaccccaaggggccctatctttgggatttacatggaattttattttctacaagtttgaccttagccatggtttgcaagtgaacagaacattctgacctctgtcttgctctgctcctttcatcctcgtctcccctgccccgtctggtgcttacattctgaatatatgtcatctcccaagaggcttcactgcctctgcttccagctgcagcctccttcctgcctgggtccccagggaagccgcctgccttttaattcagtgttcccatgagcgccaaggccccattattgcccccttgctcccactccatgctgcttctgggtggaacctaagatggcttgggagttgttgggttcctgcgatcagaagtctaccccaccacctcctcaggaaactgctgcctcccctaagaatcttccttgccctggagtagggggccagagcactttgatttccagccatttactccaagtcctctccccagctaccaccagtcccttactctgttctcccccagtgaaaaagagtctgttgattttcctcaaaactgctttattaggaatgtaccagggattgagttaggggagttggacagccccggctcctataggagtcctacttctctccagcatcctgtgccatcctcttgacgtaatcgctgtacattgtgtacacagcacctgtgtgagagaaaagaaataatgccccttggcatcaaacccttc

SEQ ID NO: 9432 - DNA, 6046 bp, Homo sapiens
taagttggcgcgtcacctagacgtcagcctcttacctctcggacgtcccgtcccaggagcaaaactctagtgactttgggcccgcccccgtgagagtggagggcggccgatgagggcggttctgaagggaacaagaccaatgagacgagcccggggcggggcgcggggccggagggtggggcgggtggcggcggtggcagtccgaggtctggctccgcgcagtatatgacagtacgtcagcagcgggatggccctagcagtggcggcggctgcagaagcccaagcagccgcggccgcagtggaggctagagccggagcggcggcggcggcggcaccccggggagtttaagatggcggcgggggggacagggggcctgcgggaggagcagcgctatgggctgtcgtgcggacggctggggcaggacaacatcaccgtactgcatgtgaagctcaccgagacggcgatccgggcgctcgagacttaccagagccacaagaatttaattccttttcgaccttcaatccagttccaaggactccacgggcttgtcaaaattcccaaaaatgatcccctcaatgaagttcataactttaacttttatttgtcaaatgtgggcaaagacaaccctcagggcagctttgactgcatccagcaaacattctccagctctggagcctcccagctcaattgcctgggatttatacaagataaaattacagtgtgtgcaacaaacgactcgtatcagatgacacgagaaagaatgacccaggcagaggaggaatcccgcaaccgaagcacaaaagttatcaaacccggtggaccatatgtagggaaaagagtgcaaattcggaaagcacctcaagctgtttcagatacagttcctgagaggaaaaggtcaacccccatgaaccctgcaaatacaattcgaaagacacatagcagcagcaccatctctcagaggccatacagggacagggtgattcacttactggccctgaaggcctacaagaaaccggagctacttgctagactccagaaagatggtgtcaatcaaaaagacaagaactccctgggagcaattctgcaacaggtagccaatctgaattctaaggacctctcatataccttaaaggattatgtttttaaagagcttcaaagagactggcctggatacagtgaaatagacagacggtcattggagtcagtgctctctagaaaactaaatccgtctcagaatgctgcaggcaccagccgttcagaatctcctgtatgttctagtagagacgctgtatcttctcctcagaaacggcttttggattcagagtttattgatcctttaatgaataaaaaagcccgaatatctcacctgacgaacagagtaccaccaacactaaatggtcatttgaatcccaccagtgaaaaatctgctgcaggcctcccgctgccccctgcggctgctgccatccctacccctccaccgctgccttcaacctatctgcccatctcacatcctcctcagattgtaaattctaactccaactcccctagcactccagaaggccgggggactcaagacctacctgttgacagttttagtcaaaacgatagtatctatgaggaccagcaagacaaatatacctctaggacttctctggaaaccttaccccctggttccgttctactaaagtgtccaaagcctatggaagaaaaccattcaatgtctcacaaaaagtccaaaaagaagtctaaaaaacataaggaaaaggaccaaataaaaaagcacgacattgagactattgaggaaaaggaggaagatcttaagagagaagaggaaattgccaagctaaataactccagtccaaattccagtggaggagttaaagaggattgcactgcctccatggaaccttcagcaattgaactcccagattatttgataaaatatatcgctatcgtctcctatgagcaacgccagaattataaggatgacttcaatgcagagtatgatgagtacagagctttgcatgccaggatggagactgtagctagaagatttatcaaactagatgcacaaagaaagcgcctttctccaggctcaaaagagtatcagaatgttcatgaagaagtcttacaagaatatcagaagataaagcagtctagtcccaattaccatgaagaaaaatacagatgtgaatatcttcataacaagctggctcacatcaaaaggctaataggtgaatttgaccaacagcaagcagagtcatggtcctagaactctgcttggaccagaagatgtgaataaacttaagcttatttatttaaaattccaaatgagttgctctagattctaaaaaggtgaaactttggctgttgaaagtttcagtattagtaaacttgagttactttttcttttccattttactttgcttccctgcatttcgaagctgctctttctggtcctccccaccaccccacccccaagacttgtgtttgttaatagaaataatttttttaggtattggggatccattgtctatatttcaaatcagttttttttcctcaaaaacttgtgtttgttattagaaatgattttttagatattggggatccagtgtccacacttaaaagttgtatgtgtttaaaaaacaacaacagtaatgtgcaaggtgaaatgcttttggataaacgtaagcctattttctgacgtttcttaatgcaaactctttgccttaaatggtagaatatttagaaatttgcacaaaattaaaaaaataaacattgtcttggagggttaaaaaatagaaaggtgtatgtgtatagattcacatacacatatgtatatacaggctgacttgatctagaacattaaatccgccctgcaagttaaccccccattgcaatggttgccttaaggtgtttgctagttgtgtacatagtgtggttaatcattagctacactgcttcccacttgattagagcaatgggaagcatactgtggcctaccagcatctggaagtgtgtgctcgatctgtatgtgtgcagaggtggtgtggatgtgagcgtgcatgaaggaaaaaaagctgctactcctagtaggccaaacgctcaggttaaacaactgacgagtgttactgtagggtgtttttttgtttttttgttttttttcttctatcaaattgctacttttgttgtggaagacaaaagcatttccatttcaacgagtttgtcagctttattaatgttgggcaaaaattgatatgtcatgaaaatgaaacagatctatagttttgggacaaaattataaaatgaaatgtgtaggtaacctatttatatactgctataaagtattttttgaagagagatatgcaaagaagctattacctacataagaggtatatttaaagattttttttttcatcctggtgccaggaatataaaaaagagtggatatatttaaccataacatactgtgattcatcaaacagcacaaactttcatttcatggagtttatctgttgacattgatttaaactgtcacttgttttatcatgtgggaacataagttatgtggtcaaaaatataaggattttgaattaatgttgattcaagttgtattgtcttattgtattgtcttttcaaagtgctgccagttgaaaagggaagcattatgtttacaaatctgttttgaaatgtttgccaaaattttggtagtgtctttaataaagatgtttgtctccagcatccagaaaaataaatgaataactttgttgtgtatcactgtaaaccagaaaaatgttggttatctagaaaacttgagagagcatgtagattaacttttctctttggagttctaaaacattaactggaaagattagataatatactaaatgtatacagaagtatacagactatacaaagactgaaacaagtcccttttgcactacaactctataacattaccgcagaaattttggttctatgtagcatggacctcctaaggaattctgtttcttttagcattgagatccctggtgctctttttttacctcagaattggtacaatcattattaaacgttaatttatttcaaactttttaattgaaaaaaggaaagggaaacttaattggggataaattcaggcatcatattattatgatagagtctcctgagtggttcgtctataggtaatgaactcattggtgttatttcttggacatcttggccttttaatcaaagactgtgtgctgctatttgctatgagcaaggtttctcaaaagcaaaaggtgcttggaccatttggatcacctgagttagaatctctaggtatagggcccaagtatctgcattttcacaggtttcttgtaggtgactttctgcaagctaaagtatgagaaccattggcttggatgtagttctaaacttttaggtctgtaaatcttgaaatcttgaactgaaggtcaactattggcttttttttttttttaatgtccatcatgtcagcaggtgcaaatcacttttcccctttgcatgatctgaggcacctcctcagttgtttcactgccaactcttgtttcagaacctgtttacaaacaagccttccagttggtgaatggttagccattggagctcctaccctgtacatcagcacatcttctggtttacaagttgggtaacaatgaaagctggagatgctaaatggaaatccagcattgcatacccttagacctgatcacataccagtaaaagccttaatttagatgttagttgtatgtgttggacagatccttgcaaaagtgtgtctgtctattagttgtaaatttgaaaattataaatctctgaatctgctactatccaagtttcatcccttttgaagatgaggcatgagcctattaaaatatttataatcatttttcgtcccctactgcaagacttttagattcttacaaatgattactacaggaatagtggccacttaatgtcagttactccggtggaagaatttatctagttttttttcttttcttttttggaaggatggtgtgaaaaatagcaagattagagaatgagttgtatagttttttctatcacatttcatctaaaatgatttgaaggacttttgaagatttttaccaacatccttaaatcaactccaggttggatgaacaactgatttaaaacaaactaagagaacattaactagatgtgggctttttaaaatatataggtattgcatttcctaccttgttatttattccactttgaatactttagagggcttaactttcaactctttaaggtagtaatggatagttttatacttgttctcacaaaattgttatggtcagtttatatcattgctccatgcattgattataaaaattcagtattaattttttctgatcttataagctttataggagttttcttttctcttataaagtgtttcaccttatgtaaaacaaatgcctgcttgcatattggaagatgttgaaattagttttagacaaaagtggtccatcaattcagacactctgcttggatgccttacccttttcattagtgcattctttgcttctgaaacttggcagaaactcgttagccagtccactgcctttctgacaatgtgtggagtcacgtatgcttggtatatgcctttactacttttaaagttctacagtttattacttgcccaagtgttactaaatccttttcttatgtgtactggatggagaaaaaattatagccagcactttgagaggaaagttttcagaaacaatattaactggcactactaactgaaggccacaggagatgctatcaatgttatttgtaatctgaagattgaacaaggctgtgaggctcatttcaaactattttgaggtgttaaaatatatatatgctgtttctcagctgttccactcaaaccgtgttaggactctcaaaggtaaaatgtcacaggggcttttcagttgttacagagctcagcagctgtggttgcccctgttctacaccaatttcagttcaataaaaatgttaactttgcaa

SEQ ID NO: 9433 - DNA, 1508 bp, Homo sapiens
tatatgacagtacgtcagcagcgggatggccctagcagtggcggcggctgcagaagcccaagcagccgcggccgcagtggaggctagagccggagcggcggcggcggcggcaccccggggagtttaagatggcggcgggggggacagggggcctgcgggaggagcagcgctatgggctgtcgtgcggacggctggggcaggacaacatcaccgtactgcatgtgaagctcaccgagacggcgatccgggcgctcgagacttaccagagccacaagaatttaattccttttcgaccttcaatccagttccaaggactccacgggcttgtcaaaattcccaaaaatgatcccctcaatgaagttcataactttaacttttatttgtcaaatgtgggcaaagacaaccctcagggcagctttgactgcatccagcaaacattctccagctctggagcctcccagctcaattgcctgggatttatacaagataaaattacagtgtgtgcaacaaacgactcgtatcagatgacacgagaaagaatgacccagattgtaaattctaactccaactcccctagcactccagaaggccgggggactcaagacctacctgttgacagttttagtcaaaacgatagtatctatgaggaccagcaagacaaatatacctctaggacttctctggaaaccttaccccctggttccgttctactaaagtgtccaaagcctatggaagaaaaccattcaatgtctcacaaaaagtccaaaaagaagtctaaaaaacataaggaaaaggaccaaataaaaaagcacgacattgagactattgaggaaaaggaggaagatcttaagagagaagaggaaattgccaagctaaataactccagtccaaattccagtggaggagttaaagaggattgcactgcctccatggaaccttcagcaattgaactcccagattatttgataaaatatatcgctatcgtctcctatgagcaacgccagaattataaggatgacttcaatgcagagtatgatgagtacagagctttgcatgccaggatggagactgtagctagaagatttatcaaactagatgcacaaagaaagcgcctttctccaggctcaaaagagtatcagaatgttcatgaagaagtcttacaagaatatcagaagataaagcagtctagtcccaattaccatgaagaaaaatacagatgtgaatatcttcataacaagctggctcacatcaaaaggctaataggtgaatttgaccaacagcaagcagagtcatggtcctagaactctgcttggaccagaagatgtgaataaacttaagcttatttatttaaaattccaaatgagttgctctagattctaaaaaggtgaaactttggctgttgaaagtttcagtattagtaaacttgagttactttttcttttccattttactttgcttccctgcatttcgaagctgctctttctggtcctccccaccaccccaccccc

SEQ ID NO: 9434 - DNA, 3452 bp, Homo sapiens
gagagaccatccacttccaccctttcacttaggcttcctggcgcagcctctatccaggaactctgtcccatagctgtactgcccaggtcgagctttctaaccccaagatgccactccgttcagacgttcccatcctccatccctgagacccggggcaggatcgcagcctaggggcctcacgggccgcctgctaccctgttagttgcaacacggggcggggcgtggctttgtgcacgtcggcttccgggaagagctttacgatacattgaccgacattttacgacaggcgggattgttttgtggctgtcagctttccccgtggtctgagtttgtggctgcatttttatctctggtggctctgctacggcggcgcagaaatgaggcagaagcggaaaggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagcaaacttaagagtagtttatttatataccctggggacagaaagtcaggttgaaacaggaaaaccaccagactctaatctcagccctttaacgacatacgcattggagcgcaagttaggaaaatgagcttttgttttcatggaaatcattctgattacagtgctgatgtttagaaataaatagcagtgtgactgggaaagaggaattgcagttgtgggggtgtgagcctggcagcagccagccagcagcctctcccaggcgggagtctaccatccgagacggcgatgacaaagagcttcattccacattctttgttatctctacttcccaccctcttggcaactacagagcagtgtgggcagccccaagtgtggtccccagagagcgtttggctttcctgtctgtctatcctgagcgggtggagtctcaggttgtgtgcccctaaatcaagatttgcttccacagaagccattacttgcaattttttttttttttctgagaaagtctcgctgtgtcacccaggctggagtgcagtggcgcaatctcactgcatcctccgcctcccgggttcaagcgattctcccgcctcagcctcctgagtagctgggattacaggcacccgccgctgctaatttttgtatttttagtagagatgggggtttcaccatattggtcaggctggtctcgaactcctgacctcaggtgatcaacccaccttggcctccctaaatgccgggattacaggcatgagccaccgctcccagcctttgattttttaaggtggattttggttgttataaatggagaaaggtaagagttcaagttcaacccgtgtgtgaaagcaaaacaatggaaaacaggattggcttcttcaaaggctcctcttgtagaactgcctctttgaaatttcgaggtaatctactttggagactctgcctggagagggtcagttcctaagttaaaagcatcgcttaaccttggctcctgtggcattttacaaaggtttaaaggaattgattcctctgaaagggcctgaaaataaaaagtctttaacatacaaagaa

SEQ ID NO: 9435 - DNA, 2019 bp, Homo sapiens
ctctggtggctctgctacggcggcgcagaaatgaggcagaagcggaaaggagatctcagccctgctgagctgatgatgctgactataggagatgttattaaacaactgattgaagcccacgagcaggggaaagacatcgatctaaataaattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagcaaacttaagagtagtttatttatataccctggggacagaaagtcaggttgaaacaggaaaaccaccagactctaatctcagccctttaacgacatacgcattggagcgcaagtta

SEQ ID NO: 9436 - DNA, 545 bp, Homo sapiens
aatagtaaactgacatggcatactggtgggcatcttatggaaagttgcttccacccctgccctgtttcagctagtcctcaacttgatccagtgtccaaactctgcctccagaacagagtcccacttcctacctcacatggtctgtgacagagccccaggggatcctgagaacatgtgtccaaggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttac

SEQ ID NO: 9437 - DNA, 3158 bp, Homo sapiens
cgaagcttcaggagacctatcctcatctgtgcaaggaggagtggccaactctggagcccaggctgttgcttcctggtctggtggtgaatcctccatagtctggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagcaaacttaagagtagtttatttatataccctggggacagaaagtcaggttgaaacaggaaaaccaccagactctaatctcagccctttaacgacatacgcattggagcgcaagttaggaaaatgagcttttgttttcatggaaatcattctgattacagtgctgatgtttagaaataaatagcagtgtgactgggaaagaggaattgcagttgtgggggtgtgagcctggcagcagccagccagcagcctctcccaggcgggagtctaccatccgagacggcgatgacaaagagcttcattccacattctttgttatctctacttcccaccctcttggcaactacagagcagtgtgggcagccccaagtgtggtccccagagagcgtttggctttcctgtctgtctatcctgagcgggtggagtctcaggttgtgtgcccctaaatcaagatttgcttccacagaagccattacttgcaattttttttttttttctgagaaagtctcgctgtgtcacccaggctggagtgcagtggcgcaatctcactgcatcctccgcctcccgggttcaagcgattctcccgcctcagcctcctgagtagctgggattacaggcacccgccgctgctaatttttgtatttttagtagagatgggggtttcaccatattggtcaggctggtctcgaactcctgacctcaggtgatcaacccaccttggcctccctaaatgccgggattacaggcatgagccaccgctcccagcctttgattttttaaggtggattttggttgttataaatggagaaaggtaagagttcaagttcaacccgtgtgtgaaagcaaaacaatggaaaacaggattggcttcttcaaaggctcctcttgtagaactgcctctttgaaatttcgaggtaatctactttggagactctgcctggagagggtcagttcctaagttaaaagcatcgcttaaccttggctcctgtggcattttacaaaggtttaaaggaattgattcctctgaaagggcctgaaaataaaaagtctttaacatacaaagaa

SEQ ID NO: 9438 - DNA, 656 bp, Homo sapiens
ccaactctggagcccaggatgttgcttcccggtctggtggtgaatcctccatagtctggagatctcagccctgctgagctgatgatgctgactataggagatgttattaaacaactgattgaagcccacgagcaggggaaagacatcgatctaaataaggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtatactgccctggtggacctgattctgattttgagtattccacccagtcttacactggctatgagccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaa

SEQ ID NO: 9439 - DNA, 1779 bp, Homo sapiens
gagtttgtggctgcatttttatctctggtggctctgctacggcggcgcagaaatgaggcagaagcggaaagggtgaaaaccaagacagctgccaaatatggcctttctgcccagccccgcctggtggatatcattgctgccgtccctcctcagtatcgcaaggtcttgatgcccaagttaaaggcgaaacccatcagaactgctagtgggattgctgtcgtggctgtgatgtgcaaaccccacagatgtccacacatcagttttacaggaaatatatgtgtccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatc

SEQ ID NO: 9440 - DNA, 1923 bp, Homo sapiens
attgaccgacattttacgacaggcgggattgttttgtggctgtcagctttccccgtggtctgagtttgtggctgcatttttatctctggtggctctgctacggcggcgcagaaatgaggcagaagcggaaaggagatctcagccctgctgagctgatgatgctgactataggagatgttattaaacaactgattgaagcccacgagcaggggaaagacatcgatctaaataaattgctgtcgtggctgtgatgtgcaaaccccacagatgtccacacatcagttttacaggaaatatatgtgtccaacctccatgagagctatccgtgccagatatgaccctttcctacagacaagacaccgaatagaacagttaaaacaacttggtcatagtgtggataaagtggagtttattgtgatgggtggaacgtttatggcccttccagaagaatacagagattattttattcgaaatttacatgatgccttatcaggacatacttccaacaatatttacgaggcagtcaagtattctgagagaagcctcacaaagtgtattggaattactattgaaaccagaccagattactgcatgaagcgacatttaagtgacatgttgacctatggctgcacaaggctggagattggggtgcagagtgtttatgaagatgtggctagagacaccaacaggggccacactgtgaaggcagtgtgtgagtcatttcacctggccaaagattccggttttaaagtggtggcccatatgatgcctgacctgccaaacgtgggactagaaagagacattgaacagttcacagagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagagggatattccaatgcctttagttagctcaggagtagagcatggtaacctgagagagctggcacttgcaagaatgaaagacctcggaatacagtgtcgagatgtgagaaccagagaagttggaatccaagaaattcatcacaaagtacggccataccaggttgaattggtaaggagagattatgttgcaaatggtggctgggaaacattcttgtcatacgaagacccagatcaagacattttgattggcctcctacgattacgcaagtgttcagaagaaactttccgtttcgaattgggtggaggtgtctccatagtacgagagctgcatgtgtatgggagtgtggtccctgtgagcagccgggatcctactaaatttcagcatcagggatttggcatgctgctgatggaggaagcagaaagaatagctagagaagaacatgggtctgggaaaatcgctgtgatatcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagc

SEQ ID NO: 9441 - DNA, 1784 bp, Homo sapiens
agagttcctattgggttaacactggaggctctaagatggcggcagtggcaacctgcggtagtgttgccgcgagtactgggtctgcagtggcgacagccagcaagagcaacgtcaccagtttccagaggaggggtcctagagccagcgtgaccaacgacagcggccctcgactggtgtccattgcgggcacgcgaccgtcggtgcggaatggacagctgctggtatcaaccgggctcccagccctagaccagctcttaggtggaggtttagccgttggaacagttcttctaattgaggaggataaatataatatttactcacctttgctcttcaagtatttcctggcagaaggaattgtcaatgggcatactttgttggttgcatctgctaaagaggatcctgccaacattttacaggaacttccagcaccattacttgatgataaatgtaaaaaggaatttgatgaagatgtatacaatcataaaacaccagaatctaatattaagatgaaaatagcttggcgttaccagttattacccaagatggagattggaccagtatcatcttcaagatttggtcactattatgatgcatcaaaaagaatgccacaagaactaattgaggcttcaaattggcatggattttttcttccagagaaaatatcttcaactctcaaagtagaaccctgttctttgacccctggctacacaaagctgcttcagtttatccagaacatcatttatgaggaaggatttgatggatccaatcctcagaaaaaacagagaaacattttaagaataggaattcagaatcttggctcacctttatggggagacgatatttgctgtgcagaaaatggtggcaacagtcacagccttaccaagttcctctatgttctccgtggtcttctgagaacctctctttcagcctgcatcatcacaatgccaacacatctgatccagaataaagccattattgcccgtgtcacaaccttgtcagatgtagtagttggtctggaatcatttattggttctgagagagaaactaacccattgtataaggattatcatggattgattcatatacggcagattcctcggcttaataacttgatctgtgatgaatcagatgtcaaagacttagcttttaaattaaaaaggaagctattcaccattgagcgactgcatttgcctccagacttgtcagacacagtgagccgctcaagcaaaatggatctggcagaatccgccaagcggctgggcccaggctgtggcatgatggccggaggcaagaagcacctggacttctagggattcctccttagtcgctgcatgcagaattctatgacactctaattatgattgctaatagcttatgtaaatatttttcttaacaatttgaccctccactccttgaaaaacacaggattataaaatggtgccgccatttctcattttttaactttttacagaactagcacagcagaaatacttttaaatttttccttcatgctctagagaaaataattttatttttaaataaacgccaaaaaatgtcaaaatctcaagattcctgacagtggtcattcgtgtgtgtactaaggcatttagtgtcatggtaaagtgcatgtcacagcaggtagcatacaaaacatgatgaaattcaagattgtatgtgaaaacatactttctctttattacagaaacagtcacttgccaccaaaaatgctgttttttaaatgaaaatgtgtttactaatatataaaataaatttgcatttatgta

SEQ ID NO: 9442 - DNA, 1679 bp, Homo sapiens
actggaggctctaagatggcggcagtggcaacctgcggtagtgttgccgcgagtactgggtctgcagtggcgacagccagcaagagcaacgtcaccagtttccagaggaggggtcctagagccagcgtgaccaacgacagcggccctcgactggtgtccattgcgggcacgcgaccgtcggtgcggaatggacagctgctggtatcaaccgggctcccagccctagaccagctcttaggtggaggtttagccgttggaacagttcttctaattgaggaggataaatataatatttactcacctttgctcttcaagtatttcctggcagaaggaattgtcaatgggcatactttgttggttgcatctgctaaagaggatcctgccaacattttacaggaacttccagcaccattacttgatgataaatgtaaaaaggaatttgatgaagatgtatacaatcataaaacaccagaatctaatattaagatgaaaatagcttggcgttaccagttattacccaagatggagcagattggaccagtatcatcttcaagatttggtcactattatgatgcatcaaaaagaatgccacaagaactaattgaggcttcaaattggcatggattttttcttccagagaaaatatcttcaactctcaaagtagaaccctgttctttgacccctggctacacaaagctgcttcagtttatccagaacatcatttatgaggaaggatttgatggatccaatcctcagaaaaaacagagaaacattttaagaataggaattcagaatcttggctcacctttatggggagacgatatttgctgtgcagaaaatggtggcaacagtcacagccttaccaagttcctctatgttctccgtggtcttctgagaacctctctttcagcctgcatcatcacaatgccaacacatctgatccagaataaagccattattgcccgtgtcacaaccttgtcagatgtagtagttggtctggaatcatttattggttctgagagagaaactaacccattgtataaggattatcatggattgattcatatacggcagattcctcggcttaataacttgatctgtgatgaatcagatgtcaaagacttagcttttaaattaaaaaggaagctattcaccattgagtgggtgcaagacaactacttgagacaagagaggaacatttatcctccaggcttctcatacttactcaagcagaaagactctgcatggggagaaggttctttacagcattccacatttttaatgagcttccttgcaaaggcgactgcatttgcctccagacttgtcagacacagtgagccgctcaagcaaaatggatctggcagaatccgccaagcggctgggcccaggctgtggcatgatggccggaggcaagaagcacctggacttctagggattcctccttagtcgctgcatgcagaattctatgacactctaattatgattgctaatagcttatgtaaatatttttcttaacaatttgaccctccactccttgaaaaacacaggattataaaatggtgccgccatttctcattttttaactttttacagaactagcacagcagaaatacttttaaatttttccttcatgctctagagaaaataattttatttttaaataaacgccaaaaaatgtc

SEQ ID NO: 9443 - DNA, 1961 bp, Homo sapiens
ctctaagatggcggcagtggcaacctgcggtagtgttgccgcgagtactgggtctgcagtggcgacagccagcaagagcaacgtcaccagtttccagaggaggggtcctagagccagcgtgaccaacgacagcggccctcgactggtgtccattgcgggcacgcgaccgtcggtgcggaatggacagctgctggtatcaaccgggctcccagccctagaccagctcttaggtggaggtttagccgttggaacagttcttctaattgaggaggataaatataatatttactcacctttgctcttcaagtatttcctggcagaaggaattgtcaatgggcatactttgttggttgcatctgctaaagaggatcctgccaacattttacaggaacttccagcaccattacttgatgataaatgtaaaaaggaatttgatgaagatgtatacaatcataaaacaccagaatctaatattaagatgaaaatagcttggcgttaccagttattacccaagatggagattggaccagtatcatcttcaagatttggtcactattatgatgcatcaaaaagaatgccacaagaactaattgaggcttcaaattggcatggattttttcttccagagaaaatatcttcaactctcaaagtagaaccctgttctttgacccctggctacacaaagctgcttcagtttatccagaacatcatttatgaggaaggatttgatggatccaatcctcagaaaaaacagagaaacattttaagaataggaattcagaatcttggctcacctttatggggagacgatatttgctgtgcagaaaatggtggcaacagtcacagccttaccaagttcctctatgttctccgtggtcttctgagaacctctctttcagcctgcatcatcacaatgccaacacatctgatccagaataaagccattattgcccgtgtcacaaccttgtcagatgtagtagttggtctggaatcatttattggttctgagagagaaactaacccattgtataaggattatcatggattgattcatatacggcagattcctcggcttaataacttgatctgtgatgaatcagatgtcaaagacttagcttttaaattaaaaaggaagctattcaccattgaggctggagtgcagtggcacgatctcggctcacggcaacctcgcctcctgggttcaagcaattctcccgcctcagcctccctagtagctgggattacaggcgcccaccaccacacccagctaatttttgtatttttagtagagatggggttccaccatgttggccaggctggtctcgaactcctgacctcaggtgattcatccgcctcagcctcccaaagtgctggaattacaggcatgagctaccgcgcccggcctagggctttgtatttcaaagagaacaagtctaaagtgggtgcaagacaactacttgagacaagagaggaacatttatcctccaggcttctcatacttactcaagcagaaagactctgcatggggagaaggttctttacagcattccacatttttaatgagcttccttgcaaaggcgactgcatttgcctccagacttgtcagacacagtgagccgctcaagcaaaatggatctggcagaatccgccaagcggctgggcccaggctgtggcatgatggccggaggcaagaagcacctggacttctagggattcctccttagtcgctgcatgcagaattctatgacactctaattatgattgctaatagcttatgtaaatatttttcttaacaatttgaccctccactccttgaaaaacacaggattataaaatggtgccgccatttctcattttttaactttttacagaactagcacagcagaaatacttttaaatttttccttcatgctctagagaaaataattttatttttaaataaacgccaaaaaatgtcaaaa

SEQ ID NO: 9444 - DNA, 1477 bp, Homo sapiens
gcccagcagatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagttcctgatgtcgggctggctgagcacctatacctggcgctgtgaccctgtggactattccaacagccctgaggcacttaggatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaaccacgga

SEQ ID NO: 9445 - DNA, 1384 bp, Homo sapiens
agatgaggaagtggcaggcaggcaggctggccccggggacttctctctggccctgctccctccgagcgctccgccgttgcccgcctggcccctacggagtccttagccaggatggaggctgttgtgaacttgtaccaagaggtgatgaagcacgcagatccccggatccagggctaccctctgatggggtcccccttgctaatgacctccattctcctgacctacgtgtacttcgttctctcacttgggcctcgcatcatggctaatcggaagcccttccagctccgtggcttcatgattgtctacaacttctcactggtggcactctccctctacattgtctatgagatggttcgggtggcctggctcttcctcttctccaagttcattgagctgatggacacagtgatctttattctccgaaagaaagacgggcaggtgaccttcctacatgtcttccatcactctgtgcttccctggagctggtggtggggggtaaagattgccccgggaggaatgggctctttccatgccatgataaactcttccgtgcatgtcataatgtacctgtactacggattatctgcctttggccctgtggcacaaccctacctttggtggaaaaagcacatgacagccattcagctgatccagtttgtcctggtctcactgcacatctcccagtactactttatgtccagctgtaactaccagtacccagtcattattcacctcatctggatgtatggcaccatcttcttcatgctgttctccaacttctggtatcactcttataccaagggcaagcggctgccccgtgcacttcagcaaaatggagctccaggtattgccaaggtcaaggccaactgagaagcatggcctagataggcgcccacctaagtgcctcaggactgcaccttagggcagtgtccgtcagtgccctctccacctacacctgtgaccaaggcttatgtggtcaggactgagcaggggactggccctcccctccccacagctgctctacagggaccacggctttggttcctcacccacttcccccgggcagctccagggatgtggcctcattgctgtctgccactccagagctgggggctaaaagggctgtacagttatttccccctccctgccttaaaacttgggagaggagcactcagggctggccccacaaagggtctcgtggcctttttcctcacacagaagaggtcagcaataatgtcactgtggacccagtctcactcctccaccccacacactgaagcagtagcttctgggccaaaggtcagggtgggcgggggcctgggaatacagcctgtggaggctgcttactcaacttgtgtcttaattaaaagtgacagaggaaacc

SEQ ID NO: 9446 - DNA, 3997 bp, Homo sapiens
gatagcgccgggcagagggacccggctaccctggacagcgcatcgccgcccgcccgggtcgccgcgccacagccgctgcggatcatggaacatctaaaggcctttgatgatgaaatcaatgcttttttggacaatatgtttggaccgcgagattctcgagtcagagggtggttcatgttggactcttaccttcctaccttttttcttactgtcatgtatctgctctcaatatggctgggtaacaagtatatgaagaacagacctgctctttctctcaggggtatcctcaccttgtataatcttggaatcacacttctctccgcgtacatgctggcagagctcattctctccacttgggaaggaggctacaacttacagtgtcaagatcttaccagcgcaggggaagctgacatccgggtagccaaggtgctttggtggtactatttctccaaatcagtagagttcctggacacaattttcttcgttttgcggaaaaaaacgagtcagattacttttcttcatgtatatcatcatgcttctatgtttaacatctggtggtgtgtcttgaactggataccttgtggacaaagtttctttggaccaacactgaacagttttatccacattcttatgtactcctactatggactttctgtgtttccatctatgcacaagtatctttggtggaagaaatatctcacacaggctcagctggtgcagttcgtgctcaccatcacgcacaccatgagcgccgtcgtgaaaccgtgtggcttccccttcggttgtctcatcttccagtcatcttatatgctaacgttagtcatcctcttcttaaatttttacgttcagacataccgaaaaaagccaatgaagaaagatatgcaagagccacctgcagggaaagaagtgaagaatggtttttccaaagcctacttcactgcagcaaatggagtgatgaacaagaaagcacaataaaaatgagtaacagaaaaagcacatatactagcctaacagattggcttgttttaaagcaaagactgaattgaaggttacatgttttaggataaactaatttcttttgagttcataaatcatttgtacccagaatgtattaatatattgctattaggttaatctgttaactgaatgctttgatcagcattgaggtgatgctcacctccgaggacctcagaactggtgcagcttctctctccctccctcccacagactgaacctttcgccagaagctgtccttataacgccttatacgcatacacagccaggaaacgtggagcattgtttctcacagagagtctccaaataaaaagggttttgttcagattaaaatgtttacaacaaaatgttaattatattctaaatacagggtatgttctaatctatattaagcaataatgccagtgcataatcattccatttgttcctttagcaatcaaccccagaaaatattaaaatgggatcatacacagaagatagaaaaatctagcaaaacttctctttctgtaagccagagtcttgtctatcagattcccacaaccactcctgattctaaatttagtgatatggtaatgaaattggtatttattttaaatattagttattctaaggagaaaaaaatgcttctgcaagattttcataattcaggggctgtggataggattgttcctctgtttccctaatcattcatctgttcatgtctccctcttgtgccagtcagcctaggttatacagatgccatgctccacaccacgagcagtgtacaaatctggctgcccgtttactttctgagcaagcactggagtccactccgacctttttctttgaacatgcatgctgctggaatatgtataaatcagaactagcagaagtagcagagtgatgggagcaaaataggcactgaattcgtcaactcttttttgtgagcctacttgtgaatattacctcagatacctgttgtcactcttcacaggttatttaagtttttgaagctgggaggaaaaagatggagtagcttggaaagattccagcactgagccgtgggccggtcatgagccacgataaaaaatgccagtttggcaaactcagcactcctgttccctgctcaggtatatgcgatctctaccgagaagcaagcacaaaagtagacaaaagtattaatgagtatttcctttctccataagtgcaggactgttactcactactaaactctaccaagaatggaaacaaagaatattttctgaagatttttttgaagattaatttataccctataaaataaaacttgttagcttcgatgaagtcacttcatcttctctcctgccttatttttttaaataagtttttaggtcctgacactgacatcaaatacatgcacaccagaaaggcatttccaccaccgtccccactcattagcgtccagagtgcctttctctctcggctttttttcccccctgagctctagttttaaactttctcctgttaaaaaaattgtacttttatttcatgtaaactgcccctctgaggatttgggcatattttttggaaggtgcctaatgcttaggatagtctctagggtgatgcactgcacctgcttccttcccttcagtgcggccgacccatttctgttgaacagatgtctcctgtgtgatgcccctgactcttacatttatctttctaaatcattttctgaagctgacttgctctagggtgcttcatcaccacttccatcttgcatcaccttataactgttctgtcttgttctctcccagcaatttattttaaaacaagggctagcttcaagcatgactgttaatggctcctctgtgacaaaacacaagttggaccaaggagaaagccctttggagaaactggaccctagttcagtttagatctcaaatataggctgaaatctcttaccaaagtgcgttccagataaaaatgagacttagaagacagactggtctaatatgctcactggtcatcacattcagcttattcttacgtgccagtgaggccctaaggtctcagtgcatagcatacctgccactctggatgttttcctgggcttcatatctgtatggcaaggagggagctgtccttcagcagacaaagtcaagcagctttaagtacaaggcagcttgaaacctctctgatgaaagtgaaaaatgtgggtagcttatactttcaaactaatgccagtgactagagagaggtttcattcatgatgtgtatttccaatttggtcttcaattcaagagatgcttcataaaacacttatagccttaaaccattcaagggctaattaaaaaaatagttatgaaatcttagccacaaaaaataaatcaggtaaacattttaacctgtcgttaagtgttgtaacttcaaaaaaccaaaatgcttattttaatgtgatttttctaaaactattgaaaaattaatatttctataatctattaaaaaaaatggagaatgttttctctcaaatttcctctgacccatgggaatgaaaatacttaaatactgtaaagcatatctattaataattcccccaattttttaaactaacaaaatggaatgttaactgaatggaattaaacatagcaattgtcaagccatcaaaattatatatcgaaccacttaggcatgttacggggtaaagtcctcacccctgcatttgagaaatattttattatttttattttaaggcaaaacagtgtttactgtgatgggcagaacagccttttgtatctaggagtccatttgagttctttccaatatttccatatcgttcataaatgtgtctgggggcttccttgtttggaaaatatggatatcgctttgttttcctttgaaagtaattatatcttaagaacatagtatcatgaatggagtagacagggaggctgcagaagccatttctctttgtagataaaaagcattatctatgattgttgtataataaattgatttttacattaaa

SEQ ID NO: 9447 - DNA, 1371 bp, Homo sapiens
ggcagctttgcaagtccgcgttatatatcgcagtggctgcgcccgggatagctggctgcgccgccgcgcacatgcctaggttcgacgccctcctccctttgcccaggagttccttctgtcccggctctgttccgtctcgccccgaggttcacgccatcctcggagccccagcctttcacccagcgcctccaagctttggaccttgacttctgcaaaactagatggtcacagccatgaatgtctcacatgaagtaaatcagctgttccagccctataacttcgagctgtccaaggacatgaggccctttttcgaggagtattgggcaacctcattccccatagccctgatctacctggttctcatcgctgtggggcagaactacatgaaggaacgcaagggcttcaacctgcaagggcctctcatcctctggtccttctgccttgcaatcttcagtatcctgggggcagtgaggatgtggggcattatggggactgtgctacttaccgggggcctaaagcaaaccgtgtgcttcatcaacttcatcgataattccacagtcaaattctggtcctgggtctttcttctcagcaaggtcatagaactcggagacacagccttcatcatcctgcgtaagcggccactcatctttattcactggtaccaccacagcacagtgctcgtgtacacaagctttggatacaagaacaaagtgcctgcaggaggctggttcgtcaccatgaactttggtgttcatgccatcatgtacacctactacactctgaaggctgccaacgtgaagccccccaagatgctgcccatgctcatcaccagcctgcagatcttgcagatgtttgtaggagccatcgtcagcatcctcacgtacatctggaggcaggatcagggatgccacaccacgatggaacacttattctggtccttcatcttgtatatgacctatttcatcctctttgcccacttcttctgccagacctacatcaggcccaaggtcaaagccaagaccaagagccagtgaaggtttggagagaacaatgaagctccaggctctctcttctccagggcaccaagaggctgggcttagttttgggagaatgattaggttgccttacctgcatggtttccccagaggatgtgtgccccaaggtggctggaatttttgacagacaagaagggtgaccttgggatgggggtgtggtctgttactttaatgtttctgtttttaatgtgaaggccaagcaggccctgggatgggagtggggcggaggagggtcctaagagctgattatttaatttctatccagaaatctttcttcttcttgctctgtttttttaaattaaagatttcaacaaaa

SEQ ID NO: 9448 - DNA, 3042 bp, Homo sapiens
agattggaggggcggctgcgcgaggctgcagactggtgcagcgcactgtgctggcggctgggcctcctccacctcctcgtctttctcccgggaaccttgacgacgccttccgcttggccctgccttctgccgcatccccgccgccgcggcgccttgaggagcaggagaagacgcagccgggccgccgccgttagaggggttcccggccgccgctcgccccgtcggccgccaccgcctccggggtcagccctctctctgggtctccgctttctcctgccgccagcgcccgctcatcgccgcgatggggctcctggactcggagccgggtagtgtcctaaacgtagtgtccacggcactcaacgacacggtagagttctaccgctggacctggtccatcgcagataagcgtgtggaaaattggcctctgatgcagtctccttggcctacactaagtataagcactctttatctcctgtttgtgtggctgggtccaaaatggatgaaggaccgagaaccttttcagatgcgtctagtgctcattatctataattttgggatggttttgcttaacctctttatcttcagagagttattcatgggatcatataatgcgggatatagctatatttgccagagtgtggattattctaataatgttcatgaagtcaggatagctgctgctctgtggtggtactttgtatctaaaggagttgagtatttggacacagtgttttttattctgagaaagaaaaacaaccaagtttctttccttcatgtgtatcatcactgtacgatgtttaccttgtggtggattggaattaagtgggttgcaggaggacaagcattttttggagcccagttgaattcctttatccatgtgattatgtactcatactatgggttaactgcatttggcccatggattcagaaatatctttggtggaaacgatacctgactatgttgcaactgattcaattccatgtgaccattgggcacacggcactgtctctttacactgactgccccttccccaaatggatgcactgggctctaattgcctatgcaatcagcttcatatttctctttcttaacttctacattcggacatacaaagagcctaagaaaccaaaagctggaaaaacagccatgaatggtatttcagcaaatggtgtgagcaaatcagaaaaacaactcatgatagaaaatggaaaaaagcagaaaaatggaaaagcaaaaggagattaaattgaactgggccttaactgttgttgacagtgaggaaaaactcccatatcatataaaatttcagggaaaacagaagcaaaggagagcttgggggtggggagaaaagacaaatgtgctctatgtcctagtaactcttagactgagtaaagtgttaataccatacccagatgttttatttatgaagtttttattttaaacattttttttaaaaattagccttgatattctccagaccaaagcaatcattaagtgactttggggattctccccctgttcacatccagttgtctaaaggatgagatttttcatgtatcttatagtcactcattcttcggtctgaattttagacgatcacagaaacggtctttatgaattattttgataaattactaattatcttatctactgactgaaatcagtggtgttacattttcttgtccaaagctgaaaatgtgtatacacttaaacttgcacatttgaattcatttgctgaccggaatggtcaaatctctccacctctagtcagagtataattttggttgtaattaaatttttaaaatctgctgatctctgtagaatcttagaggcttgatgatgatggtgttggtgaaaataagaaagaattgcagtaaagtcttgtctggtgacccagagatcaccatgacttgaggcacaaatcactgtggggaaacaattttttgtgatgaaaaggcagcatttgaatactcctgttagtagcagaaatatattatgaaaattaagattattgtctgattgaaacatgaaacaactcatgtctttattagtaacatcataagatagttacatttatgtgctgttagaatatgttgatttttatcaggctttccttgttttgatttatggctgttcctgatttttcatatgtggaaatatacctacctcttccgttggaaagaacatttaaaattaaataaattttaattaaaaaatcaaggagtcttctaatgtaaattttaatgttaactttcaaatccactagtattttttttgcttttatgacaaatagcatacaccaaacatttctgtgaaactatccttctctttcaatgtgtttaattttggagtaacgttttccttgtgactaagttgcaagatcttatttattaactaggtatgaagtataaacccattttggtgcaatattcttgactccttggtgctaaagattgttaaattcaatgcttgatgttacaaggtgttgttaaaacacaaaatgaataaaagtgagagtagtcagaactataacattcaatttgctatttacaaatgaagtatttcatgtaatataagtgaacaactggaaataaagtaggaaagaatttgtatcatgttttactacataggttaattttttaagggatgttgcaaagggattactagagaaagacaaaatgtgaccaaaaaaaagcatgaatatttcttaagtatctcaacaacatgtcaaagctgcatgtgtaggatgtatgctgtttgtacaaactatttcagaatattttgtaagctataacatatttattgtgcattaaaattaaatactttttccccaaaggcatgcagtcatgagaattacagaaaatttgcaacatataaagtagtttgatctaagaggattcaacacctttgttttgttgctcagtgtgtaatgactgagatttgtaaatctttgtgaacattctgtactggttcccaagagctattcattccctgctacctgatttcagcacaataaatatacttctgctgtgggaaaaata

SEQ ID NO: 9449 - DNA, 2827 bp, Homo sapiens
gcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgattacctgt

SEQ ID NO: 9450 - DNA, 580 bp, Homo sapiens
ccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgaggtatcagcagctctgtcctcagaatgggtcccccacttcacacagttgtaggatggctacagcagctccaagcagcacattcagaggaagaagaaaaaatgtttcatttgtgtggttttaagcataaagaagttgtttcccagagctctttgccagctgtcatccctcaaaactcactggccacaattgcttcacatgcccctgcctgaaccagccaccagagggggttaggaccaccacagattgactagatcctaaggattctctacctggggctggagttcgggtcaggtgcccgggaagcactgtgcggtgtgggaggatgaatatgtgccaatttggaaagatgagtatttgtgggaaaatgaataaagcaaagtgtaaatcagaggtttaagttaaaa

SEQ ID NO: 9451 - DNA, 2940 bp, Homo sapiens
aggggccaaccccggcctaggctctccaccgcatcggattctggaatttacgatcacgaaagttctattgtcccgcgattggctcccgggccgcatgacatcatagcgcttgattcatccttcgggtcccgattggctggccgcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataagttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgattacctgtg

SEQ ID NO: 9452 - DNA, 1491 bp, Homo sapiens
ctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagtccaaaagggagcaaccccgtcgatctgcctgtgcctcacgaactgatccttcgactcagcagcagctgccagaaaacaggttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgt

SEQ ID NO: 9453 - DNA, 3070 bp, Homo sapiens
gtcgggggccgccgctcggccatgacacccgcgcgagcgcgcggccgggaagcggtcagagagaactgccgttaggtctcggacctggtgccgagaaagagctgccggggcaacccgcgctccgcccgcggcctccagctccgccggctccggggtacagcccggctcctcgggcgcggggaaaggggtgcgggtgcgggcgcgggcggctcgccccacgccgaggctgaggcagggcgctcgggagcgttctctgtgctgcggtcccacctgtgcgcgctgacaggcgccgcggggcacgacaccgtgcccacaccagacgcggagggatggatctgtccgcctgggtcctcccgccctgcgggccggagcgcgcggcgggagagccgggggagcgctctcggagggagcgcgctttctttggagtcggcgaaacccgggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgatt

SEQ ID NO: 9454 - DNA, 3090 bp, Homo sapiens
cacgagggggaggagatttccctgtagacgagtaaaaagggtgatggacaaacgtgcgggcactaagaccgcaaggcattcatttcctcctacggtggatgcggacgccgggaggaggagagccccagagagaggagctgggagcggaggcgcaggcaatgctcagccctggatgtagctgagaggctgggagaagagacgaccgctggagaccgagcggcgtggggaagacctaggggggtgggtgggggaagcagacaggagaacactcgaaatcaagcgctttacagattattttattttgtatagagaacacgtagcgactccgaagatcagccccaatgaacatgtcagtgttgactttacaagaatatgaattcgaaaagcagttcaacgagaatgaagccatccaatggatgcaggaaaactggaagaaatctttcctgttttctgctctgtatgctgcctttatattcggtggtcggcacctaatgaataaacgagcaaagtttgaactgaggaagccattagtgctctggtctctgacccttgcagtcttcagtatattcggtgctcttcgaactggtgcttatatggtgtacattttgatgaccaaaggcctgaagcagtcagtttgtgaccagggtttttacaatggacctgtcagcaaattctgggcttatgcatttgtgctaagcaaagcacccgaactaggagatacaatattcattattctgaggaagcagaagctgatcttcctgcactggtatcaccacatcactgtgctcctgtactcttggtactcctacaaagacatggttgccgggggaggttggttcatgactatgaactatggcgtgcacgccgtgatgtactcttactatgccttgcgggcggcaggtttccgagtctcccggaagtttgccatgttcatcaccttgtcccagatcactcagatgctgatgggctgtgtggttaactacctggtcttctgctggatgcagcatgaccagtgtcactctcactttcagaacatcttctggtcctcactcatgtacctcagctaccttgtgctcttctgccatttcttctttgaggcctacatcggcaaaatgaggaaaacaacgaaagctgaatagtgttggaactgaggaggaagccatagctcagggtcatcaagaaaaataatagacaaaagaaaatggcacaaggaatcacacgtggtgcagctaaaacaaaacaaaacatgagcaaacacaaaacccaaggcagcttagggataattaggttgatttaacccagtaagtttatgatccttttagggtgaggactcactgagtgcacctccatctccaagcactgctgctggaagaccccattccctctttatctatcaactctaggacaagggagaacaaaagcaagccagaagcagaggagactaatcaaaggcaaacaaaggctattaacacataggaaaaaatgtatttactaagtgtcacatttctctaagatgaaagatttttactctagaaactgtgcgagcacaacacacacaatcctttctaactttatggacactaaactggagccaatagaaaagacaaaaatgaaagagacacagggtgtatatctagaacgataatgcttttgcagaaactaaagcctttttaagaaatgccagctgctgtagaccccatgagaaaagatgtcttaatcatccttatgaaaacagatgtaaacaactatatttcaactaacttcatcttcactgcatagcctcaggctagtgagtttgccaaaaccaaagggggtgaatacttccccaagattcttcctgggaggatggaaacagtgcagcccaggtcccatgggggcagctccatcccagagcatttctgatagttgaactgtaatttctactcttaagtgagatatgaagcattatccttttgttcagttgccccgggcttttgaacagaagagtaaatacagaattgaaaaagataaacactcaaccaaacaatgtgaaaacgggttctgtagtatttgtaaaaaggcccggcccaggaccactgtgagctggaaaagggagaaaggcagtgggaaaagaggtgagccgaagatcaattcgacagacagatggtgtgtatgcccctccctgtttgacttcacacacactcataactttccaaatgaaaccccacagtatagcgcatattttcgatatttttgtgaattccaaaaggaaatcacagggctgttcgaaatattgggggaacactgtgtttctgcatcatctgcatttgctccccaagcaatgtagaggtgtttaaagggccctctgctggctgagtggcaatactacaacaaacttcaaggcaagtttggctgaaaacagttgacaacaaagggcccccatacacttatccctcaaattttaagtgatatgaaatacttgtcatgtctttggccaaatcagaagatattcatcctgcttcaagtcagcttcagaaatgttttaaaagggactttagctctggaactcaaaatcaatttattaagagccatattctttaaaaaaaaaaagctggataatattctctgtaatatttcagtcctttacaagccaaatacatgtgtcaatgtttctagtatttcaaagaagcaattatgtaaagttgttcaatgtgacataatagtattataattggttaagtagcttaatgattaggcaaactagatgaaaagattaggggcttccacactgcatagattacacgcacatagccacgcatacacacacagacacacagatgtggggtacactgaacttcaaagcccaaatgaatagaaacacattttctggctagcagaaaaaaacaaaacaaaactgttgtttctctttcttgctttgagagtgtacagtaaaagggattttttcgaattatttttatattattttagctttaattgtgctgtcgttcatgaaacagagctgctctgcttttctgtcagagatggcaagggctttttcagcatctcgtttatgtgtggaatttaaaaagaataaagttttattccattctg

SEQ ID NO: 9455 - DNA, 6454 bp, Homo sapiens
gtagacgagtaaaaagggtgatggacaaacgtgcgggcactaagaccgcaaggcattcatttcctcctacggtggatgcggacgccgggaggaggagagccccagagagaggagctgggagcggaggcgcagagaacacgtagcgactccgaagatcagccccaatgaacatgtcagtgttgactttacaagaatatgaattcgaaaagcagttcaacgagaatgaagccatccaatggatgcaggaaaactggaagaaatctttcctgttttctgctctgtatgctgcctttatattcggtggtcggcacctaatgaataaacgagcaaagtttgaactgaggaagccattagtgctctggtctctgacccttgcagtcttcagtatattcggtgctcttcgaactggtgcttatatggtgtacattttgatgaccaaaggcctgaagcagtcagtttgtgaccagggtttttacaatggacctgtcagcaaattctgggcttatgcatttgtgctaagcaaagcacccgaactaggagatacaatattcattattctgaggaagcagaagctgatcttcctgcactggtatcaccacatcactgtgctcctgtactcttggtactcctacaaagacatggttgccgggggaggttggttcatgactatgaactatggcgtgcacgccgtgatgtactcttactatgccttgcgggcggcaggtttccgagtctcccggaagtttgccatgttcatcaccttgtcccagatcactcagatgctgatgggctgtgtggttaactacctggtcttctgctggatgcagcatgaccagtgtcactctcactttcagaacatcttctggtcctcactcatgtacctcagctaccttgtgctcttctgccatttcttctttgaggcctacatcggcaaaatgaggaaaacaacgaaagctgaatagtgttggaactgaggaggaagccatagctcagggtcatcaagaaaaataatagacaaaagaaaatggcacaaggaatcacacgtggtgcagctaaaacaaaacaaaacatgagcaaacacaaaacccaaggcagcttagggataattaggttgatttaacccagtaagtttatgatccttttagggtgaggactcactgagtgcacctccatctccaagcactgctgctggaagaccccattccctctttatctatcaactctaggacaagggagaacaaaagcaagccagaagcagaggagactaatcaaaggcaaacaaaggctattaacacataggaaaaaatgtatttactaagtgtcacatttctctaagatgaaagatttttactctagaaactgtgcgagcacaacacacacaatcctttctaactttatggacactaaactggagccaatagaaaagacaaaaatgaaagagacacagggtgtatatctagaacgataatgcttttgcagaaactaaagcctttttaagaaatgccagctgctgtagaccccatgagaaaagatgtcttaatcatccttatgaaaacagatgtaaacaactatatttcaactaacttcatcttcactgcatagcctcaggctagtgagtttgccaaaaccaaagggggtgaatacttccccaagattcttcctgggaggatggaaacagtgcagcccaggtcccatgggggcagctccatcccagagcatttctgatagttgaactgtaatttctactcttaagtgagatatgaagcattatccttttgttcagttgccccgggcttttgaacagaagagtaaatacagaattgaaaaagataaacactcaaccaaacaatgtgaaaacgggttctgtagtatttgtaaaaaggcccggcccaggaccactgtgagctggaaaagggagaaaggcagtgggaaaagaggtgagccgaagatcaattcgacagacagatggtgtgtatgcccctccctgtttgacttcacacacactcataactttccaaatgaaaccccacagtatagcgcatattttcgatatttttgtgaattccaaaaggaaatcacagggctgttcgaaatattgggggaacactgtgtttctgcatcatctgcatttgctccccaagcaatgtagaggtgtttaaagggccctctgctggctgagtggcaatactacaacaaacttcaaggcaagtttggctgaaaacagttgacaacaaagggcccccatacacttatccctcaaattttaagtgatatgaaatacttgtcatgtctttggccaaatcagaagatattcatcctgcttcaagtcagcttcagaaatgttttaaaagggactttagctctggaactcaaaatcaatttattaagagccatattctttaaaaaaaaaaagctggataatattctctgtaatatttcagtcctttacaagccaaatacatgtgtcaatgtttctagtatttcaaagaagcaattatgtaaagttgttcaatgtgacataatagtattataattggttaagtagcttaatgattaggcaaactagatgaaaagattaggggcttccacactgcatagattacacgcacatagccacgcatacacacacagacacacagatgtggggtacactgaacttcaaagcccaaatgaatagaaacacattttctggctagcagaaaaaaacaaaacaaaactgttgtttctctttcttgctttgagagtgtacagtaaaagggattttttcgaattatttttatattattttagctttaattgtgctgtcgttcatgaaacagagctgctctgcttttctgtcagagatggcaagggctttttcagcatctcgtttatgtgtggaatttaaaaagaataaagttttattccattctgtgtgaatggtttgagcagtgaacaaagaatccatgcaaaccaagtcatgactggaagaaatggggagtgggggacagtgcaggggaggaaagctgttacatctatgttaaatgattgtgagcagtctataatgtcttgatgttggttcataggtgagacacaactgatggaggaatgtattataaattatgcaaaatctgacatgagctgaaaagacaggtccttttataagagctaatagatgcttaggatgcaaatgttattttgagcttcgcaaatacatgataccgtgcaataagccttttttccttataacagaaaatgagaataattaaaatgaggagaaggccacataacagttgacttgaatttaattgaaggacccattggaggctcatctggttgatttaattatttaattgagtgatttattgcagatctcttaatgcaggttagaaacggaagtgagcataaaccttaaaaagactctaaatgatgcttccaaagcactttcattttggtattaggttcatgtttgtttgtctttacttgtaaaataatttggaatttttgtttacagggtgaatgtcttaatagttttaaaattagctaaatatatctaaaggcatttccaatgtttatcatgggaggaaaaaagccacattttttttaaaacaaaacaaaacaaaacaaaattttggtaatataggttcaatacactgtttttaacatctcagcttagccgctttaatcatatcaagatatgaggctggatcactggcccatgacaaatctgaaacctaccagagaattgactgctgcatagataatcctgctgccagttaacattccagaaaaacttgggcaggcaagtttttatagctgccccactatgctgcaatagagtatctttctattgaagattttccactgcatcccgatcctactatggtgaaagcattgttcttgggctaaaaaaaaatcctttatttcatacacacatgatttcatacactaggtctgagcatcaagccaagtccatgagtttgcaatgaagttctagtgagaaatgctctattcataaagcagggggtttacgtggaccttctagtgttgcttatgggaaaagagtaactaccatattacatctaacgcaaggccaaagtaccaaattaaaaccatggattgaggtggttattcgaagtcacttactcccatccttctaattatgctccactacaaaagtaaggggagaagagggaatactttacatgtacattgctagagggaaaagaaaggcttgattatatcccctcgcttctccacctctctgctcatgtaaagaaactgatgagaaaagagactaatatgtctagactgagttagaaacttcatatgagtgggttttgtagaattgatgggaaagacagtgggaacctagaagaacagaaagagacccacagaatgtctttctttttttttttttttttttttttgaggtggattcttgctgttgttgcccaggctggagtgcagtggcgcgatctagactcactgcaacctccgcctcccaggttccagcaattctcctgcctcagcctcccaaatagctgaggttacaggcgcccgccaccacacccagctaatttttgtatttttagtagagacagggtttcaccatgttggccaggctggtctcgagctcctgacctcaggggatccacccgccttggtctcccaaagtgctgggattataggcgtgagccaccgtgcctggcccagaatgtttttttaaatcagatgtagcatcttcataaggtaaagcctgtcacatcagagtaacaaagctcctggagtacagtgatgctagagtagaatgttccagaagtctggccatagccccagcttctgaattacctgggagagacaagatgctcaggttactattttttctttattctgatagtacagcctctactcagagaccacggtgtgtgtcacacaaccgaggcagctagggcatattctgagggcttttttttttttttggtttccttaatgattctttaacagagtaactggattggccaaggtctgattcaagaggctgtgaggagagtagagaacaaatagactttgcctctcagagttcagagctttaagttgtataagcatggtccatgtccacctcttgtagacacttattccttaaaagtttccatcatgaaaaataatatcatgtcaaaattttataagcacccagaatgtcccagtagtcaaatgtagtgtctttctccagtctctgttttcgataataaataccttgctctcaatttaggatgatcgtaaagcctatgttcatgctgtgagtcattgtctcccacagcttttgaaacatcgttctttgtcttttctatacaacacctgattctttgtgcctcagactcattgctatcaggaagagactttgccaagatccaccaccacatttggccagtagtgtatacacattaaagtgagagctgatgaaatcacaatgctctattttgttccgacaatcagtatgaaggggtaggtcccagtttgccaatgagcaacagcctctgtatgctggtgtccaagacttacacaaaacaagtgtcagtgcagtcacagcattttcttgaatgctgttgtgacagactccagttataaacatctgcgagccatatggcacaactcatagctaaagaggccggtacagggcacatgcacagagctttgaagaacatacacaaacctgttgaatcaagttactttcctcatcctcagagactttgacaattcagagctcacagatggcagggggaattctcaggcttcccttcctcctgattgacactttttaaaggaagtgatgtggaagttgttctagaagttagatggacagtgggagcacattcgtgagtggggcttgggagagctcaaaagtggcactttgattttaggctgggcaggcagaagtctcacagtaaaatatatttcactagacgtccaaaccaacactgcattgtagtaacctcttctgaagtaactggttaaattaataactggtcccataagtcagggtcaagccacatttataacccattcgggccggccatgaagggttctgactcgacattggtatttaaatgctgttactttcccaatgcttagtagcacttgagactttatttccatcgacaaaaactaagaaggccacagaagtagcctaacagtcctccctggtcatactcgtttcaaacaggtctgcctgtctagacatattcaggcaggaggttgcttgctgctatcttgaaaaccactggaagattcagcttcttggggacctcagagcccatattcatatggaagcccacccatataagcctcacagagcaaatcacagcaatgttgaagttgttattttcaagtgcttatttcacgacattaaaaaaaatattttttcctggtgtattaaaattaaaaataaaatcataacttttgatttaaaatcaaa

SEQ ID NO: 9456 - DNA, 458 bp, Homo sapiens
ccacttccggctactagcctctctcgcctatccactatcctcacactcagcatcccctgtctgtacgagattaaggagctctgccgtccgcagggcctggagaacacgtagcgactccgaagatcagccccaatgaacatgtcagtgttgactttacaagaatatgaattcgaaaagcagttcaacgagaatgaagccatccaatggatgcaggaaaactggaagaaatctttcctgttttctgctctgtatgctgcctttatattcggtggtcggcacctaatgaataaacgagcaaagtttgaactgaggaagccattagtgctctggtctctgacccttgcagtcttcagtatattcggtgctcttcgaactggtgcttatatggtgtacattttgatgaccaaaggcctgaagcagtcagtttgtgaccagggtttttacaatggacctgtcag

SEQ ID NO: 9457 - DNA, 610 bp, Homo sapiens
attcccttcactggtgatctcaacgtagatttgcccggagttctcttgcaagagagctggcaggttttactatttcccaatcgtttactcgccaagctctcgggtccacgcgccgcggggatgcgccctgcaagctgaaacttcattcaaagcaaggcggcccacgagagaacacgtagcgactccgaagatcagccccaatgaacatgtcagtgttgactttacaagaatatgaattcgaaaagcagttcaacgagaatgaagccatccaatggatgcaggaaaactggaagaaatctttcctgttttctgctctgtatgctgcctttatattcggtggtcggcacctaatgaataaacgagcaaagtttgaactgaggaagccattagtgctctggtctctgacccttgcagtcttcagtatattcggtgctcttcgaactggtgcttatatggtgtacattttgatgaccaaaggcctgaagcagtcagtttgtgaccagggtttttacaatggacctgtcagcaaattctgggcttatgcatttgtgctaagcaaagcacccgaactaggagatacaatattcattattctgaggaagcagaagct

SEQ ID NO: 9458 - DNA, 3827 bp, Homo sapiens
aacccagtcggcggccgggacagcgggggccgctgtgaggagctccgcgctcgcgctgccagtcgccgccctctctcccgcgcgcgcccggcgcttcggctccgctccctgtgcgaacccattaaaagagccagtaaatcctgtggaaaatggccttcagtgatcttacatcgaggactgtgcatctttatgataattggatcaaagatgctgatccaagagttgaagattggctcctcatgtcctcgcctctgccacaaaccatcctcctaggattctatgtctattttgtcacttccttgggaccaaagctcatggaaaatcgcaagccctttgaactcaagaaagcaatgataacgtacaattttttcatagtactcttttctgtgtatatgtgttatgagtttgtgatgtctggctggggtataggttattcatttcgatgtgacattgttgactattcacggtcacccacagctttgaggatggcacgtacctgctggctttattacttctccaaatttattgagctattagatacgatcttttttgttctgcgcaagaaaaatagccaagtgactttccttcatgtattccatcataccatcatgccgtggacctggtggtttggagtcaaatttgctgcaggtggtttgggaacattccatgcccttctaaatacagctgtacatgtagtcatgtattcctactatggactttctgcattggggccagcctaccagaagtatttgtggtggaaaaaatatttgacatcattacagcttgtccagtttgttattgtcgccatccacataagccagttctttttcatggaggattgcaagtatcagtttccagtctttgcgtgcatcattatgagttacagtttcatgtttctgctgctctttctccatttttggtaccgtgcttacaccaaaggtcagaggttgcccaaaactgtgaaaaatggaacttgcaaaaacaaagataattgaagcccaacataagtctatgatcgaaactgatacattgtcttccttgacaatcaagagatatttacctatgcagtgcattttgtatatttttcaaaactaagagcttgtatttttatggtaagttattgggatgtctgatatttgagagcccgaagcttccagataacagtcttctgataattagagcctacagcagccagaatttgtttttgtttttgtttttgtttttttagctgcttttaaacctaatccaaaggttttgtttaaaacattttgttgcagtgaaaaaaagatatgaagcaatacagtactcttcaaagaagtccaataaagatgaaaaatatcattaggtattttgagcacagacggagatccatgtgataaaatagattccttctgctgggtctggaaagtctggaaaccacctgtaggccctggctttgtcatttattgactgtattcagaagatactatatttgctctagagttaactcccattttagcaagctagcacaggtgaaaattgagtgagtttttgataacttgtcatttaaaatcattaatgataattttcaatggatcttttcagtagccatcaccagttttgctgataagacttcctcacaacccatttgttgtacaaactgtttcaaagtagcaatcctttgggttagtacacttgataccaagtttcattcagttgattattttcaaaacaaggtgatttgttttaatgggttaatgaatactttgctattactgttttacaattaactttgtatatctctggaaagaggtgaatttgtcaatgaaaaaagtattgtgtagttcagtgggaaaaacctgttgtctgttatagtatcacatcactttcttacattgtcatggtttaaattattatcttggtgaaatatataggttagatacttaaatgttcatattattagcacactacaggtactacccttaaatcataaataatattacccattgtacacagtttccagatatgagttagagtggctgtgaagcaactagaggcaaattgtggcacagagaatatccaggggaaaattgattatgtaagcaagggctgttctactttgagagagagacagacagactacataatagtaatatattatataattaatgttatagatacactgaacaataaaacattttctggaattatgaattaattaacaacctggatttctgtttccagacctataaaccatgtaatgaaggactgaaattcgtttggcatacactttgtttctttaaaattgctagtttctttctgttatttttacattttcttgtcagagaatcaaaactattagtcagtagagttttgtccatgaaataatatttggacatttgtgaatttttccctattttttttcttcttttatttatactcaattttgaagcactgtttatgtttgtaggactttaaacaattagtacttaaagccccagttaattttgaacacacagagatacttattgtactctgtgtacagtaagtatttttatgtttacacttaccagattcataaggttatttgcctttaagtgatcttttgtgattttacttgattacagcatgagaaggtaaaggttgataaatgggagtaattacatatatatatataatttattatttttttttctgaagcagagttttactcttgttgcccaggctagagtgcaatggcacaatctcggttcactgcaacctctgcctcccaggttcaagtgattctcctgtctcagcctcccaagtagctgggattacaggtgcccgccaccatgctcagctaatttttgtatttttagtagagacagggttggccaggctggtctcgagctcctgacctcaggtgatcctcccacctcggcctcccaaagttctgggattacaggggtgagccactgtgcccggccataattttatatttttagaaaataaagaatgaaggacaaaagagcacagctaaatgaaactgctgctctaatttattccactggaaaggtctcaggactccttaactgttttccaggtttggctcttcatatctaacctgtgctaaaatgagaaggtatgctaggtgctgttagaaatcacaccatttccaaagaacccaagtagtatagagaccaaaatgaggcaaaaataaaagagatgaaacaggagagtttatttcttgcatactttccgaccttcatcatacaacctctcctaacctccctgtagtctttaaaatgtttaacttgcctataagctaacatgtaataaaacacatactcaattatatgaatagaagtggagagccagaatgctacaaaagaaatcacagctgctagaagtatcctccatagaaacatcaacatgattgtggatcaaaatgattttcactggatatggaatttgtatgggccatatttattaaaagagttctgtgtggtcacatagagttcctttgggatttcatcccacttttcaggacttaatttgtttgggtttgcttacctaacaagcaacaacaacaacaaaataaatagttccaaaatctagtttattacataaatctctatgaatccttgagggcctatatctatattataaataaatacaaatatagatttttaaatatctatgggactttgccatttacagccttaagtataaaattacgagattatattctttccattaccctttatttctgctaactttttaaagactggaacattctgtggatgttgtcaaagtttgagtttgtttttccctgtgtattataataaatttgtggtattgcatgt

SEQ ID NO: 9459 - DNA, 3871 bp, Homo sapiens
aacccagtcggcggccgggacagcgggggccgctgtgaggagctccgcgctcgcgctgccagtcgccgccctctctcccgcgcgcgcccggcgcttcggctccgctccctgtgcggcatttatagattataaactcatttctgttttattttactgaagaacccattaaaagagccagtaaatcctgtggaaaatggccttcagtgatcttacatcgaggactgtgcatctttatgataattggatcaaagatgctgatccaagagttgaagattggctcctcatgtcctcgcctctgccacaaaccatcctcctaggattctatgtctattttgtcacttccttgggaccaaagctcatggaaaatcgcaagccctttgaactcaagaaagcaatgataacgtacaattttttcatagtactcttttctgtgtatatgtgttatgagtttgtgatgtctggctggggtataggttattcatttcgatgtgacattgttgactattcacggtcacccacagctttgaggatggcacgtacctgctggctttattacttctccaaatttattgagctattagatacgatcttttttgttctgcgcaagaaaaatagccaagtgactttccttcatgtattccatcataccatcatgccgtggacctggtggtttggagtcaaatttgctgcaggtggtttgggaacattccatgcccttctaaatacagctgtacatgtagtcatgtattcctactatggactttctgcattggggccagcctaccagaagtatttgtggtggaaaaaatatttgacatcattacagcttgtccagtttgttattgtcgccatccacataagccagttctttttcatggaggattgcaagtatcagtttccagtctttgcgtgcatcattatgagttacagtttcatgtttctgctgctctttctccatttttggtaccgtgcttacaccaaaggtcagaggttgcccaaaactgtgaaaaatggaacttgcaaaaacaaagataattgaagcccaacataagtctatgatcgaaactgatacattgtcttccttgacaatcaagagatatttacctatgcagtgcattttgtatatttttcaaaactaagagcttgtatttttatggtaagttattgggatgtctgatatttgagagcccgaagcttccagataacagtcttctgataattagagcctacagcagccagaatttgtttttgtttttgtttttgtttttttagctgcttttaaacctaatccaaaggttttgtttaaaacattttgttgcagtgaaaaaaagatatgaagcaatacagtactcttcaaagaagtccaataaagatgaaaaatatcattaggtattttgagcacagacggagatccatgtgataaaatagattccttctgctgggtctggaaagtctggaaaccacctgtaggccctggctttgtcatttattgactgtattcagaagatactatatttgctctagagttaactcccattttagcaagctagcacaggtgaaaattgagtgagtttttgataacttgtcatttaaaatcattaatgataattttcaatggatcttttcagtagccatcaccagttttgctgataagacttcctcacaacccatttgttgtacaaactgtttcaaagtagcaatcctttgggttagtacacttgataccaagtttcattcagttgattattttcaaaacaaggtgatttgttttaatgggttaatgaatactttgctattactgttttacaattaactttgtatatctctggaaagaggtgaatttgtcaatgaaaaaagtattgtgtagttcagtgggaaaaacctgttgtctgttatagtatcacatcactttcttacattgtcatggtttaaattattatcttggtgaaatatataggttagatacttaaatgttcatattattagcacactacaggtactacccttaaatcataaataatattacccattgtacacagtttccagatatgagttagagtggctgtgaagcaactagaggcaaattgtggcacagagaatatccaggggaaaattgattatgtaagcaagggctgttctactttgagagagagacagacagactacataatagtaatatattatataattaatgttatagatacactgaacaataaaacattttctggaattatgaattaattaacaacctggatttctgtttccagacctataaaccatgtaatgaaggactgaaattcgtttggcatacactttgtttctttaaaattgctagtttctttctgttatttttacattttcttgtcagagaatcaaaactattagtcagtagagttttgtccatgaaataatatttggacatttgtgaatttttccctattttttttcttcttttatttatactcaattttgaagcactgtttatgtttgtaggactttaaacaattagtacttaaagccccagttaattttgaacacacagagatacttattgtactctgtgtacagtaagtatttttatgtttacacttaccagattcataaggttatttgcctttaagtgatcttttgtgattttacttgattacagcatgagaaggtaaaggttgataaatgggagtaattacatatatatatataatttattatttttttttctgaagcagagttttactcttgttgcccaggctagagtgcaatggcacaatctcggttcactgcaacctctgcctcccaggttcaagtgattctcctgtctcagcctcccaagtagctgggattacaggtgcccgccaccatgctcagctaatttttgtatttttagtagagacagggttggccaggctggtctcgagctcctgacctcaggtgatcctcccacctcggcctcccaaagttctgggattacaggggtgagccactgtgcccggccataattttatatttttagaaaataaagaatgaaggacaaaagagcacagctaaatgaaactgctgctctaatttattccactggaaaggtctcaggactccttaactgttttccaggtttggctcttcatatctaacctgtgctaaaatgagaaggtatgctaggtgctgttagaaatcacaccatttccaaagaacccaagtagtatagagaccaaaatgaggcaaaaataaaagagatgaaacaggagagtttatttcttgcatactttccgaccttcatcatacaacctctcctaacctccctgtagtctttaaaatgtttaacttgcctataagctaacatgtaataaaacacatactcaattatatgaatagaagtggagagccagaatgctacaaaagaaatcacagctgctagaagtatcctccatagaaacatcaacatgattgtggatcaaaatgattttcactggatatggaatttgtatgggccatatttattaaaagagttctgtgtggtcacatagagttcctttgggatttcatcccacttttcaggacttaatttgtttgggtttgcttacctaacaagcaacaacaacaacaaaataaatagttccaaaatctagtttattacataaatctctatgaatccttgagggcctatatctatattataaataaatacaaatatagatttttaaatatctatgggactttgccatttacagccttaagtataaaattacgagattatattctttccattaccctttatttctgctaactttttaaagactggaacattctgtggatgttgtcaaagtttgagtttgtttttccctgtgtattataataaatttgtggtattgcatgt

SEQ ID NO: 9460 - DNA, 730 bp, Homo sapiens
agtcggcggccgggacagcgggggccgctgtgaggagctccgcgctcgcgctgccagtcgccgccctctctcccgcgcgcgcccggcgcttcggctccgctccctgtgcgatacttaggaacttcaagcagtcgtcccagatataaaaggcatttaaacttccctcttagaactgcttttgtggcatcccataagttttgaacccattaaaagagccagtaaatcctgtggaaaatggccttcagtgatcttacatcgaggactgtgcatctttatgataattggatcaaagatgctgatccaagagttgaagattggctcctcatgtcctcgcctctgccacaaaccatcctcctaggattctatgtctattttgtcacttccttgggaccaaagctcatggaaaatcgcaagccctttgaactcaagaaagcaatgataacgtacaattttttcatagtactcttttctgtgtatatgtgttatgagtttgtgatgtctggctggggtataggttattcatttcgatgtgacattgttgactattcacggtcacccacagctttgaggatggcacgtacctgctggctttattacttctccaaatttattgagctattagatacgatcttttttgttctgcgcaagaaaaatagccaagtgactttccttcatgtattccatcataccatcatgccgtggacctggtggtttggagtcaaatttgctg

SEQ ID NO: 9461 - DNA, 3994 bp, Homo sapiens
tccctccggccctcggcgggcacctggcggcggcgggcagggggcggcgctgcgcgcgtcacgcggctgggtgggatagcgggcaggtgacacccggcggcctcctcccctttccaacccagtcggcggccgggacagcgggggccgctgtgaggagctccgcgctcgcgctgccagtcgccgccctctctcccgcgcgcgcccggcgcttcggctccgctccctgtgcggcatttaaacttccctcttagaactgcttttgtggcatcccataagttttgaacccattaaaagagccagtaaatcctgtggaaaatggccttcagtgatcttacatcgaggactgtgcatctttatgataattggatcaaagatgctgatccaagagttgaagattggctcctcatgtcctcgcctctgccacaaaccatcctcctaggattctatgtctattttgtcacttccttgggaccaaagctcatggaaaatcgcaagccctttgaactcaagaaagcaatgataacgtacaattttttcatagtactcttttctgtgtatatgtgttatgagtttgtgatgtctggctggggtataggttattcatttcgatgtgacattgttgactattcacggtcacccacagctttgaggatggcacgtacctgctggctttattacttctccaaatttattgagctattagatacgatcttttttgttctgcgcaagaaaaatagccaagtgactttccttcatgtattccatcataccatcatgccgtggacctggtggtttggagtcaaatttgctgcaggtggtttgggaacattccatgcccttctaaatacagctgtacatgtagtcatgtattcctactatggactttctgcattggggccagcctaccagaagtatttgtggtggaaaaaatatttgacatcattacagcttgtccagtttgttattgtcgccatccacataagccagttctttttcatggaggattgcaagtatcagtttccagtctttgcgtgcatcattatgagttacagtttcatgtttctgctgctctttctccatttttggtaccgtgcttacaccaaaggtcagaggttgcccaaaactgtgaaaaatggaacttgcaaaaacaaagataattgaagcccaacataagtctatgatcgaaactgatacattgtcttccttgacaatcaagagatatttacctatgcagtgcattttgtatatttttcaaaactaagagcttgtatttttatggtaagttattgggatgtctgatatttgagagcccgaagcttccagataacagtcttctgataattagagcctacagcagccagaatttgtttttgtttttgtttttgtttttttagctgcttttaaacctaatccaaaggttttgtttaaaacattttgttgcagtgaaaaaaagatatgaagcaatacagtactcttcaaagaagtccaataaagatgaaaaatatcattaggtattttgagcacagacggagatccatgtgataaaatagattccttctgctgggtctggaaagtctggaaaccacctgtaggccctggctttgtcatttattgactgtattcagaagatactatatttgctctagagttaactcccattttagcaagctagcacaggtgaaaattgagtgagtttttgataacttgtcatttaaaatcattaatgataattttcaatggatcttttcagtagccatcaccagttttgctgataagacttcctcacaacccatttgttgtacaaactgtttcaaagtagcaatcctttgggttagtacacttgataccaagtttcattcagttgattattttcaaaacaaggtgatttgttttaatgggttaatgaatactttgctattactgttttacaattaactttgtatatctctggaaagaggtgaatttgtcaatgaaaaaagtattgtgtagttcagtgggaaaaacctgttgtctgttatagtatcacatcactttcttacattgtcatggtttaaattattatcttggtgaaatatataggttagatacttaaatgttcatattattagcacactacaggtactacccttaaatcataaataatattacccattgtacacagtttccagatatgagttagagtggctgtgaagcaactagaggcaaattgtggcacagagaatatccaggggaaaattgattatgtaagcaagggctgttctactttgagagagagacagacagactacataatagtaatatattatataattaatgttatagatacactgaacaataaaacattttctggaattatgaattaattaacaacctggatttctgtttccagacctataaaccatgtaatgaaggactgaaattcgtttggcatacactttgtttctttaaaattgctagtttctttctgttatttttacattttcttgtcagagaatcaaaactattagtcagtagagttttgtccatgaaataatatttggacatttgtgaatttttccctattttttttcttcttttatttatactcaattttgaagcactgtttatgtttgtaggactttaaacaattagtacttaaagccccagttaattttgaacacacagagatacttattgtactctgtgtacagtaagtatttttatgtttacacttaccagattcataaggttatttgcctttaagtgatcttttgtgattttacttgattacagcatgagaaggtaaaggttgataaatgggagtaattacatatatatatataatttattatttttttttctgaagcagagttttactcttgttgcccaggctagagtgcaatggcacaatctcggttcactgcaacctctgcctcccaggttcaagtgattctcctgtctcagcctcccaagtagctgggattacaggtgcccgccaccatgctcagctaatttttgtatttttagtagagacagggttggccaggctggtctcgagctcctgacctcaggtgatcctcccacctcggcctcccaaagttctgggattacaggggtgagccactgtgcccggccataattttatatttttagaaaataaagaatgaaggacaaaagagcacagctaaatgaaactgctgctctaatttattccactggaaaggtctcaggactccttaactgttttccaggtttggctcttcatatctaacctgtgctaaaatgagaaggtatgctaggtgctgttagaaatcacaccatttccaaagaacccaagtagtatagagaccaaaatgaggcaaaaataaaagagatgaaacaggagagtttatttcttgcatactttccgaccttcatcatacaacctctcctaacctccctgtagtctttaaaatgtttaacttgcctataagctaacatgtaataaaacacatactcaattatatgaatagaagtggagagccagaatgctacaaaagaaatcacagctgctagaagtatcctccatagaaacatcaacatgattgtggatcaaaatgattttcactggatatggaatttgtatgggccatatttattaaaagagttctgtgtggtcacatagagttcctttgggatttcatcccacttttcaggacttaatttgtttgggtttgcttacctaacaagcaacaacaacaacaaaataaatagttccaaaatctagtttattacataaatctctatgaatccttgagggcctatatctatattataaataaatacaaatatagatttttaaatatctatgggactttgccatttacagccttaagtataaaattacgagattatattctttccattaccctttatttctgctaactttttaaagactggaacattctgtggatgttgtcaaagtttgagtttgtttttccctgtgtattataataaatttgtggtattgcatgta

SEQ ID NO: 9462 - DNA, 737 bp, Homo sapiens
gagccgcatcctgtcttggtggctgctgctggccgggaggaggctgatgaatacagagccgtggaacaggtcgtgccggagatggaaacaggaaagcctgttgttttgtcgtcccagatacttaggaacttcaagcagtcgtcccagatataaaaggcatttaaacttccctcttagaactgcttttgtggcatcccataagttttgaacccattaaaagagccagtaaatcctgtggaaaatggccttcagtgatcttacatcgaggactgtgcatctttatgataattggatcaaagatgctgatccaagagttgaagattggctcctcatgtcctcgcctctgccacaaaccatcctcctaggattctatgtctattttgtcacttccttgggaccaaagctcatggaaaatcgcaagccctttgaactcaagaaagcaatgataacgtacaattttttcatagtactcttttctgtgtatatgtgttatgagtttgtgatgtctggctggggtataggttattcatttcgatgtgacattgttgactattcacggtcacccacagctttgaggatggcacgtacctgctggctttattacttctccaaatttattgagctattagatacgatcttttttgttctgcgcaagaaaaatagccaagtgactttccttcatgtattccatcataccatcatgccgtggacctggtggtttggagtcaaatttgctg

SEQ ID NO: 9463 - DNA, 3118 bp, Homo sapiens
ctccaggcaacttggggcaagcgtctcagttctcgctctcccttcctcccagcggggtcgccgcagaccccagccctgggagcaccgctctgcagcgcggccggcgggtggagacggttggcccctaaactcgctcgtccagcccaaccgccccggcggcttctcccagccctcgaggctctcctgagcggcctggagaggcgtcgagcgcagcccagcgcccgcctgctcacccgccccggcccgggaagggaattttcggatcctgcgagcccggggcgcccccgcggcctagggcgggcagctcccggggcctggccgagccggtggcgcccgggaggccgcggggacagcacgcagcgcgcgcccttggatgccgtcccgcagcgacgccccggcccgccccgctcctcctcctgcctggctagcctgcctctcatttgggaagttttgtgggttttctttctcctcctccaaccttggcggaggccacgactcaggcgccacagctgggggctagaggccgcggaccatggtgcggggcagccaccgctgaagtcagcaaaaccgagcctggcctgaggcaggctgcgcgggaggccaaagccatggccattgccacgtcgacccagctggcccgggcactgtatgacaacaccgctgagtccccccaggagctgtccttccgccgaggggatgtcctacgggtcctgcagagagagggcgctggtggactggacggctggtgcctctgctccctacacggccagcagggcattgtgcccgccaacagggtgaagctcttgcctgctggcccagcacccaagcccagcctctctcctgcgtccccagcccagcctggctcaccatatccagccccagatcacagcaatgaggaccaggaggtgtatgtggtgccgcccccagctcggccctgtccaacctcaggacctccagctggaccttgcccaccctctcctgacctcatctacaaaatccccagagctagtgggacccagctggctgctcccagagatgccttggaggtctacgatgtgccccccaccgccctccgggtgccctccagtggcccctatgactgccctgcctccttttcccaccctctgacccgggttgccccgcagccccctggagaggatgatgctccctatgatgtgcctctgaccccaaagccacctgcagagctggaaccagatctggagtgggaaggaggccgggagccggggccccccatctatgctgccccctccaacctgaaacgagcgtcagccttactcaatttgtatgaagcacccgaggaactgctggcagacggggagggcgggggcactgatgaggggatctacgatgtgcctctgctggggccagaggctcccccttctccagagccccctggagccttggcctcccatgaccaggacaccctggcccagcttctggccagaagccccccacccccacacaggccccggctcccctcagctgagagcctgtcccgccgccctctgcctgccctgcctgtccctgaggcccccagcccctccccagtgccctctcctgccccaggccggaagggcagcatccaggaccggcctctgcccccacccccaccccgcctgcctggttatggaggccccaaggtcgagggggatccagagggcagggagatggaggatgacccagcaggacaccacaatgagtacgagggcattccgatggccgaggagtatgactatgtccacctgaagggcatggacaaagctcagggatctaggcccccggatcaggcctgcacaggggatcctgaactgcccgagagggggatgccggcgccgcaggaggccctgtccccaggggagccactggttgtgtccaccggagatctgcagctcctgtacttctatgctgggcaatgccagagccactactcagccctgcaggcagccgtggcagccctgatgtccagtacccaggctaatcagcccccgcgccttttcgtgccccacagcaagagggtggtggtggctgctcatcgcctggtgtttgttggggacaccctgggccggctggcagcctctgcccctctgagagcacaggtcagggctgcaggtacagcactgggccaggcattgcgggccactgtgctggctgtcaagggagctgccctgggctacccatccagccctgccatccaagagatggtgcagtgtgtaacagaactggcagggcaggccctgcaattcactaccctgctcactagcctggctccatgaaggtcctttggcacagctctgctcctcccctgcctgccaaagcccccctttaggccttgggtggctggaaggctttgttaagggactaggagaaatgggggtatctttcccctttcctgccctttctgctcatctcaacctctcacagaggtgtcttctccccctaacctacagctttttgtacaagccattttgtgtaaattatttatatttaatattattccctgctttgtcaggagcaggtactaggctctggggcagtgaggaactagatccttctctcctcagcctagggtggaggtcactgcactaccacccacctctggaagactggctgtgaaaagtcaggtggcagaaacctggggccacatagagcctctctcttttcctgtttcttggctctagaagatcagcactgcactgttagctgagagtgcgggcaagacataaactgtccagagtttgaaggttctcggaaagaccggagggcttctccccacagaaggcggagagagctggggctcagacatgggtgtgcaccttaataaaccctgctgtctgcctccctgactctgcttcttgggagcatggtgagcagccctggtgctcagcagccatacctatgggacacacactacgaaaaggatgcctttagggtttgggggagattttactcctttcttcaacaactattcactggacaagttctctgctcccatgacgcgccaggcacagttctgcaagtatattgtgaatgtattgttctagtgggatacacaaataagtcagttaaaatacataaataaaaacataaacctgccata

SEQ ID NO: 9464 - DNA, 2704 bp, Homo sapiens
cgggcgcgctgagtgagtgcgcgcgtgaaaaccgccgcaccgccgggggtgcgagtgtctgggccgaagcggccactccagcgacccagccccacggccacgctctcgggggcctttggctccaggcaacttggggcaagcgtctcagttctcgctctcccttcctcccagcggggtcgccgcagaccccagccctgggagcaccgctctgcagcgcggccggcgggtggagacggttggcccctaaactcgctcgtccagcccaaccgccccggcggcttctcccagccctcgaggctctcctgagcggcctggagaggcgtcgagcgcagcccagcgcccgcctgctcacccgccccggcccgggaagggaattttcggatcctgcgagcccggggcgcccccgcggcctagggcgggcagctcccggggcctggccgagccggtggcgcccgggaggccgcggggacagcacgcagcgcgcgcccttggatgccgtcccgcagcgacgccccggcccgccccgctcctcctcctgcctggctagcctgcctctcatttgggaagttttgtgggttttctttctcctcctccaaccttggcggaggccacgactcaggcgccacagctgggggctagaggccgcggaccatggtgcggggcagccaccgctgaagtcagcaaaaccgagcctggcctgaggcaggctgcgcgggaggccaaagccatggccattgccacgtcggtgtatgtggtgccgcccccagctcggccctgtccaacctcaggacctccagctggaccttgcccaccctctcctgacctcatctacaaaatccccagagctagtgggacccagctggctgctcccagagatgccttggaggtctacgatgtgccccccaccgccctccgggtgccctccagtggcccctatgactgccctgcctccttttcccaccctctgacccgggttgccccgcagccccctggagaggatgatgctccctatgatgtgcctctgaccccaaagccacctgcagagctggaaccagatctggagtgggaaggaggccgggagccggggccccccatctatgctgccccctccaacctgaaacgagcgtcagccttactcaatttgtatgaagcacccgaggaactgctggcagacggggagggcgggggcactgatgaggggatctacgatgtgcctctgctggggccagaggctcccccttctccagagccccctggagccttggcctcccatgaccaggacaccctggcccagcttctggccagaagccccccacccccacacaggccccggctcccctcagctgagagcctgtcccgccgccctctgcctgccctgcctgtccctgaggcccccagcccctccccagtgccctctcctgccccaggccggaagggcagcatccaggaccggcctctgcccccacccccaccccgcctgcctggttatggaggccccaaggtcgagggggatccagagggcagggagatggaggatgacccagcaggacaccacaatgagtacgagggcattccgatggccgaggagtatgactatgtccacctgaagggcatggacaaagctcagggatctaggcccccggatcaggcctgcacaggggatcctgaactgcccgagagggggatgccggcgccgcaggaggccctgtccccaggggagccactggttgtgtccaccggagatctgcagctcctgtacttctatgctgggcaatgccagagccactactcagccctgcaggcagccgtggcagccctgatgtccagtacccaggctaatcagcccccgcgccttttcgtgccccacagcaagagggtggtggtggctgctcatcgcctggtgtttgttggggacaccctgggccggctggcagcctctgcccctctgagagcacaggtcagggctgcaggtacagcactgggccaggcattgcgggccactgtgctggctgtcaagggagctgccctgggctacccatccagccctgccatccaagagatggtgcagtgtgtaacagaactggcagggcaggccctgcaattcactaccctgctcactagcctggctccatgaaggtcctttggcacagctctgctcctcccctgcctgccaaagcccccctttaggccttgggtggctggaaggctttgttaagggactaggagaaatgggggtatctttcccctttcctgccctttctgctcatctcaacctctcacagaggtgtcttctccccctaacctacagctttttgtacaagccattttgtgtaaattatttatatttaatattattccctgctttgtcaggagcaggtactaggctctggggcagtgaggaactagatccttctctcctcagcctagggtggaggtcactgcactaccacccacctctggaagactggctgtgaaaagtcaggtggcagaaacctggggccacatagagcctctctcttttcctgtttcttggctctagaagatcagcactgcactgttagctgagagtgcgggcaagacataaactgtccagagtttgaaggttctcggaaagaccggagggcttctccccacagaaggcggagagagctggggctcagacatgggtgtgcaccttaataaaccctgctgtctgcctccctga

SEQ ID NO: 9465 - DNA, 1706 bp, Homo sapiens
gctagcctgcctctcatttgggaagttttgtgggttttctttctcctcctccaaccttggcggaggccacgactcaggcgccacagctgggggctagaggccgcggaccatggtgcggggcagccaccgctgaagtcagcaaaaccgagcctggcctgaggcaggctgcgcgggaggccaaagccatggccattgccacgtcggtgtatgtggtgccgcccccagctcggccctgtccaacctcaggacctccagctggaccttgcccaccctctcctgacctcatctacaaaatccccagagctagtgggacccagctggctgctcccagagatgccttggaggtctacgatgtgccccccaccgccctccgggtgccctccagtggcccctatgactgccctgcctccttttcccaccctctgacccgggttgccccgcagccccctggagaggatgatgctcccccttctccagagccccctggagccttggcctcccatgaccaggacaccctggcccagcttctggccagaagccccccacccccacacaggccccggctcccctcagctgagagcctgtcccgccgccctctgcctgccctgcctgtccctgaggcccccagcccctccccagtgccctctcctgccccaggccggaagggcagcatccaggaccggcctctgcccccacccccaccccgcctgcctggttatggaggccccaaggtcgagggggatccagagggcagggagatggaggatgacccagcaggacaccacaatgagtacgagggcattccgatggccgaggagtatgactatgtccacctgaagggcatggacaaagctcagggatctaggcccccggatcaggcctgcacaggggatcctgaactgcccgagagggggatgccggcgccgcaggaggccctgtccccaggggagccactggttgtgtccaccggagatctgcagctcctgtacttctatgctgggcaatgccagagccactactcagccctgcaggcagccgtggcagccctgatgtccagtacccaggctaatcagcccccgcgccttttcgtgccccacagcaagagggtggtggtggctgctcatcgcctggtgtttgttggggacaccctgggccggctggcagcctctgcccctctgagagcacaggtcagggctgcaggtacagcactgggccaggcattgcgggccactgtgctggctgtcaagggagctgccctgggctacccatccagccctgccatccaagagatggtgcagtgtgtaacagaactggcagggcaggccctgcaattcactaccctgctcactagcctggctccatgaaggtcctttggcacagctctgctcctcccctgcctgccaaagcccccctttaggccttgggtggctggaaggctttgttaagggactaggagaaatgggggtatctttcccctttcctgccctttctgctcatctcaacctctcacagaggtgtcttctccccctaacctacagctttttgtacaagccattttgtgtaaattatttatatttaatattattccctgctttgtcaggagcaggtactaggctctggggcagtgaggaactagatccttctctcctcagcctagggtggaggtcactgcactaccacccacctctggaagactggctgtgaaa

SEQ ID NO: 9466 - DNA, 2223 bp, Homo sapiens
attcgccagatgggggaagccagggggaagcaggttactgtttttgcatttctatcttcaaggaagaattaggttatgaatagttccgtgaatagtcaggaagcgctgtcctccaagttcaagattaaggaaacgtggcatgcacagctaaagcaagaggtgacgtcttgtatcttcccccgtttcctgggacattggtggtgtagcccattccacagactttcgctccctagcagcgggtcggagatcgaaggaacgggccaattgcggctgaaacgtctttggaaggaggaagggggtgagggagcatccctttgagtttcgcctcttctcgaggcggtggtgggaagggagacatacttaatactgccctcttaatccaacggaccttacatcgtgtagactgccgggagggcggcgggaaaagggcaagacgggagttggggaagggaaggagccaggaagccgcgcgggagggcgcgcgcgcgcgcccctttttcagcagtgtggcggggtcgcacgcacgcccgcctcggcggctgggcgcgatttgcgacagtggggggggcggtggaggtggcggcggcagcggcaactttgcggcaagctcgggccgggcttgcttgacggcggtgtggcggaggccccgccccaggcggcaggaacctggagggaggcggaggaatatgtccgagagggaagtgtcgactgcgccggcgggaacagacatgcctgcggccaagaagcagaagctgagcagtgacgagaacagcaatccagacctctctggagacgagaatgatgacgctgtcagtatagaaagtggtacaaacactgaacgccctgatacacctacaaacacgccaaatgcacctggaaggaaaagttggggaaagggaaaatggaagtcaaagaaatgcaaatattctttcaaatgtgtaaatagtctcaaggaagatcataaccaaccattgtttggagttcagtttaactggcacagtaaagaaggagatccattagtgtttgcaactgtaggaagcaacagagttaccttgtatgaatgtcattcacaaggagaaatccggttgttgcaatcttacgtggatgctgatgctgatgaaaacttttacacttgtgcatggacctatgatagcaatacgagccatcctctgctggctgtagctggatctagaggcataattaggataataaatcctataacaatgcagtgtataaagcactatgttggccatggaaatgctatcaatgagctgaaattccatccaagagatccaaatcttctcctgtcagtaagtaaagatcatgctttacgattatggaatatccagacggacactctggtggcaatatttggaggcgtagaagggcacagagatgaagttctaagtgctgattatgatcttttgggtgaaaaaataatgtcctgtggtatggatcattctcttaaactttggaggatcaattcaaagagaatgatgaatgcaattaaggaatcttatgattataatccaaataaaactaacaggccatttatttctcagaaaatccattttcctgatttttctaccagagacatacataggaattatgttgattgtgtgcgatggttaggcgatttgatactttctaagtcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaaatgtacaacactgactcatcataaatgtggtgctgctattcgacaaaccagttttagcagggatagcagcattcttatagctgtttgtgatgatgccagtatttggcgctgggatcgacttcgataaaatacttttgcctaatcaaaattagagtgtgtttgttgtctgtgtaaaatagaattaatgtatcttgctagtaagggcacgtagagcatttagagttgtctttcagcattcaatcaggctgagctgaatgtagtgatgtttacattgtttacattctttgtactgtcttcctgctcagactctactgcttttaataaaaatttatttttgt

SEQ ID NO: 9467 - DNA, 2033 bp, Homo sapiens
tttgcggcaagctcgggccgggcttgcttgacggcggtgtggcggaggccccgccccaggcggcaggaacctggagggaggcggaggaatatgtccgagagggaagtgtcgactgcgccggcgggaacagacatgcctgcggccaagaagcagaagctgagcagtgacgagaacagcaatccagacctctctggagacgagaatgatgacgctgtcagtatagaaagtggtacaaacactgaacgccctgatacacctacaaacacgccaaatgcacctggaaggaaaagttggggaaagggaaaatggaagtcaaagaaatgcaaatattctttcaaatgtgtaaatagtctcaaggaagatcataaccaaccattgtttggagttcagtttaactggcacagtaaagaaggagatccattagtgtttgcaactgtaggaagcaacagagttaccttgtatgaatgtcattcacaaggagaaatccggttgttgcaatcttacgtggatgctgatgctgatgaaaacttttacacttgtgcatggacctatgatagcaatacgagccatcctctgctggctgtagctggatctagaggcataattaggataataaatcctataacaatgcagtgtataaagcactatgttggccatggaaatgctatcaatgagctgaaattccatccaagagatccaaatcttctcctgtcagtaagtaaagatcatgctttacgattatggaatatccagacggacactctggtggcaatatttggaggcgtagaagggcacagagatgaagttctaagtgctgattatgatcttttgggtgaaaaaataatgtcctgtggtatggatcattctcttaaactttggaggatcaattcaaagagaatgatgaatgcaattaaggaatcttatgattataatccaaataaaactaacaggccatttatttctcagaaaatccattttcctgatttttctaccagagacatacataggaattatgttgattgtgtgcgatggttaggcgatttgatactttctaagtcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaagtaagtatttagaaatttctgttcaaaatttcaggctttttctccacacttgtatgccaatgtagagaagatcatttatatttgcagtgccatccttaagtcatttttaacatttactgttttcagagttaaagttattcttttttattccaataatttttgtttttcctaagtaccttggtgacaagtcatttcttgtttttatacaaattatgtagtgcttgttgaacttaaaatatatctaaattttataaaatttgagactgagctcttagtgaagtatattctggttttaagtgcttttcgtatgacttggaacatctgcttattttctaatccgctgttttagggtagacactgacaacgttatgtgtggtctttaacctgttgtcatgttttttccctagatgtacaacactgactcatcataaatgtggtgctgctattcgacaaaccagttttagcagggatagcagcattcttatagctgtttgtgatgatgccagtatttggcgctgggatcgacttcgataaaatacttttgcctaatcaaaattagagtgtgtttgttgtctgtgtaaaatagaattaatgtatcttgctagtaagggcacgtagagcatttagagttgtctttcagcattcaatcaggctgagctgaatgtagtgatgtttacattgtttacattctttgtactgtcttcctgctcagactctactgcttttaataaaaatttatttttg

SEQ ID NO: 9468 - DNA, 2069 bp, Homo sapiens
ctagcagcgggtcggagatcgaaggaacgggccaattgcggctgaaacgtctttggaaggaggaagggggtgagggagcatccctttgagtttcgcctcttctcgaggcggtggtgggaagggagacatacttaatactgccctcttaatccaacggaccttacatcgtgtagactgccgggagggcggcgggaaaagggcaagacgggagttggggaagggaaggagccaggaagccgcgcgggagggcgcgcgcgcgcgcccctttttcagcagtgtggcggggtcgcacgcacgcccgcctcggcggctgggcgcgatttgcgacagtggggggggcggtggaggtggcggcggcagcggcaactttgcggcaagctcgggccgggcttgcttgacggcggtgtggcggaggccccgccccaggcggcaggaacctggagggaggcggaggaatatgtccgagagggaagtgtcgactgcgccggcgggaacagacatgcctgcggccaagaagcagaagctgagcagtgacgagaacagcaatccagacctctctggagacgagaatgatgacgctgtcagtatagaaagtggtacaaacactgaacgccctgatacacctacaaacacgccaaatgcacctggaaggaaaagttggggaaagggaaaatggaagtcaaagaaatgcaaatattctttcaaatgtgtaaatagtctcaaggaagatcataaccaaccattgtttggagttcagtttaactggcacagtaaagaaggagatccattagtgtttgcaactgtaggaagcaacagagttaccttgtatgaatgtcattcacaaggagaaatccggttgttgcaatcttacgtggatgctgatgctgatgaaaacttttacacttgtgcatggacctatgatagcaatacgagccatcctctgctggctgtagctggatctagaggcataattaggataataaatcctataacaatgcagtgtataaagcactatgttggccatggaaatgctatcaatgagctgaaattccatccaagagatccaaatcttctcctgtcagtaagtaaagatcatgctttacgattatggaatatccagacggacactctggtggcaatatttggaggcgtagaagggcacagagatgaagttctaagtgctgattatgatcttttgggtgaaaaaataatgtcctgtggtatggatcattctcttaaactttggaggatcaattcaaagagaatgatgaatgcaattaaggaatcttatgattataatccaaataaaactaacaggccatttatttctcagaaaatccattttcctgatttttctaccagagacatacataggaattatgttgattgtgtgcgatggttaggcgatttgatactttctaagagtggccgtgccattttacattcccaccagcaatgtatgagagatccagtgtctccgaatcttcgccagcatttgtcttgtgaaaatgccattgtgtgctggaaacctggcaagatggaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaaatgtacaacactgactcatcataaatgtggtgctgctattcgacaaaccagttttagcagggatagcagcattcttatagctgtttgtgatgatgccagtatttggcgctgggatcgacttcgataaaatacttttgcctaatcaaaattagagtgtgtttgttgtctgtgtaaaatagaattaatgtatcttgctagtaagggcacgtagagcatttagagttgtctttcagcattcaatcaggctgagctgaatgtagtgatgtttacattgtttacattctttgtactgtcttcctgctcagactctactgcttttaataaaaatttatttttgt

SEQ ID NO: 9469 - DNA, 786 bp, Homo sapiens
aggaatatgtccgagagggaagtgtcgactgcgccggcgggaacagacatgcctgcggccaagaagcagaagctgagcagtgacgagaacagcaatccagacctctctggagacgagaatgatgacgctgtcagtatagaaagtggtacaaacactgaacgccctgatacacctacaaacacgccaaatgcacctggaaggaaaagttggggaaagggaaaatggaagtcaaagaaatgcaaatattctttcaaatgtgtaaatagtctcaaggaagatcataaccaaccattgtttggagttcagtttaactggcacagtaaagaaggagatccattagtgtttgcaactgtaggaagcaacagagttaccttgtatgaatgtcattcacaaggagaaatccggttgttgcaatcttacgtggatgctgatgctgatgaaaacttttacacttgtgcatggaaatgctatcaatgagctgaaattccatccaagagatccaaatcttctcctgtcagtaagtaaagatcatgctttacgattatggaatatccagacggacactctggtggcaatatttggaggcgtagaagggcacagagatgaagttctaagtgctgattatgatcttttgggtgaaaaaataatgtcctgtggtatggatcattctcttaaactttggaggatcaattcaaagagaatgatgaatgcaattaaggaatcttatgattataatccaaataaaactaacagtcttgtgaaaatgccattgtgtgctggaaacct

SEQ ID NO: 9470 - DNA, 966 bp, Homo sapiens
tcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtagacttgaattcgactagaggggatgcagatatgtatgatcttcccaagaaagaggacgctttactctaccagagcaagggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggatagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggca

SEQ ID NO: 9471 - DNA, 1379 bp, Homo sapiens
gacgtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtaggatcaactcgtaggctttacgagaagaagatcttcgagtacgagacccagaggcggcggctctcgccccccagctcgtccgccgcctcctcttatagcttctctgacttgaattcgactagaggggatgcagatatgtatgatcttcccaagaaagaggacgctttactctaccagagcaagggctacaatgacgactactatgaagagagctacttcaccaccaggacttatggggagcccgagtctgccggcccgtccagggctgtccgccagtcagtgacttcattcccagatgctgacgctttccatcaccaggtgcatgatgacgatcttttgtcttcttctgaagaggagtgcaaggatagggaacgccccatgtacggccgggacagtgcctaccagagcatcacgcactaccgccctgtttcagcctccaggagctccctggacctgtcctattatcctacttcctcctccacctcttttatgtcctcctcatcatcttcctcttcatggctcacccgccgtgccatccggcctgaaaaccgtgctcctggggctgggctgggccaggatcgccaggtcccgctctggggccagctgctgcttttcctggtctttgtgatcgtcctcttcttcatttaccacttcatgcaggctgaagaaggcaaccccttctagagggagccatgagggtctgggcttcagagctaggtctttggggaagtcctggctgactgccttagcagtgggggtgggggtgggggcaggggcaggggctttatgtgtttttgcttggggggcgctgggcctagcccagagtagtgcttgctccccctgccttgtcccaccagggaggcagcagactcaggccctccatggtcctctttgtcattttgttgacatgcattcctccttttgtcatcttgttggggggaggggattaaccaaaggccaccctgactttgtttttgtggacacacaataaaagccccgtttatttgtaa

SEQ ID NO: 9472 - DNA, 609 bp, Homo sapiens
cggagccagcgtgggaggccgctgccgtcgcgcgccttggttgacggcgttgcacgctctcgcggggaggctctggctttccaaacgctggcaccgagggtttttctgttccttttttttttttttttttaacttcctgcctatacacacgcagccatcagcccacaaagacatgactaccaacgcgggccccttgcacccatactggcctcagcacctaagactggacaactttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctggaaagagtatgccaagggagacagccgatacatcctgggtgacaacttcacagtgtgcatggaaaccatcacagcttgcctgtggggaccactcagcctgtgggtggtgatcgcctttctccgccagcatcccct

SEQ ID NO: 9473 - DNA, 714 bp, Homo sapiens
cctaaagagagcccggagccagcgtgggaggccgctgccgtcgcgcgccttgcgctgcacgccagacaccggcctttcaatatccgtctcttccctgcaggttgacggcgttgcacgctctcgcggggaggctctggctttccaaacgctggcaccgagggtttttctgttccttttttttttttttttttaacttcctgcctatacacacgcagccatcagcccacaaagacatgactaccaacgcgggccccttgcacccatactggcctcagcacctaagactggacaactttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctggaaagagtatgccaagggagacagccgatacatcctgggtgacaacttcacagtgtgcatggaaaccatcacagcttgcctgtggggaccactcagcctgtgggtggtgatcgcctttctccgccagcatcccctccgcttcattctacagcttgtggtctctgtgggccagatctatg

SEQ ID NO: 9474 - DNA, 1775 bp, Homo sapiens
tctaattggatgggaggtctgggatgggtctggattctgattgattgctccatctgggggcccactggtggttaggcgtttgattggctttttagaactggcatatggagattgagggtcttcatgccaattggtcagtaggactgagaggcctgggttctaactagttcttctgacttgaggtcgggagaagagagaatgaccgctgctattaggactgaggagttctgagcactgaagagctggggagggggtggttgcagtgtatagcgtgtgatctgcttgtaacagtttcgttgcattatactaagggttactctacctagaaaagggcggaggtgaaaggatgcaacgcaacgctaatttcaccagcggaagaagcgggtacagaccttaatgagtccccgttttgatcgactgataagggaatggggaaattgaagccaggactcgatgcagattggctacggatccaaaacgcccactaaccttggcgcgtcccagtctccaccccaaacctaactcaggtgaaaatggcgccacgcgcgggggcggggctagaggtacaaagagagtgtctattggttgggagcggcacgggccgccttcttcgcttcaccattggctcgctccgtaaggcaagagaacccactaggggatgagcccgaactagggatgtgacagagcgcgagacccagcctaaagagagcccggagccagcgtgggaggccgctgccgtcgcgcgccttggtttttctgttccttttttttttttttttttaacttcctgcctatacacacgcagccatcagcccacaaagacatgactaccaacgcgggccccttgcacccatactggcctcagcacctaagactggacaactttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctggaaagagtatgccaagggagacagccgatacatcctgggtgacaacttcacagtgtgcatggaaaccatcacagcttgcctgtggggaccactcagcctgtgggtggtgatcgcctttctccgccagcatcccctccgcttcattctacagcttgtggtctctgtgggccagatctatggggatgtgctctacttcctgacagagcaccgcgacggattccagcacggagagctgggccaccctctctacttctggttttactttgtcttcatgaatgccctgtggctggtgctgcctggagtccttgtgcttgatgctgtgaagcacctcactcatgcccagagcacgctggatgccaaggccacaaaagccaagagcaagaagaactgaggagtggtggaccaggctcgaacactggccgaggaggagctctctgcctgccagaagagtctagtcctgctcccacagtttggagggacaaagctaattgatctgtcacactcaggctcatgggcaggcacaagaaggggaataaaggggctgtgtgaaggcactgctgggagccattagaacacagatacaagagaagccaggaggtctatgatggtgacgatttttaaaatcaggaaataaaagatcttgactctaa

SEQ ID NO: 9475 - DNA, 2188 bp, Homo sapiens
aggtgagcggcggccaatgggcgagcgcggggcaggtgcccgctaactcgcgcctcgcagcgctgggcggccggggctgggcagggcagtgcggggacaccgggggctggggtcggtcccagcgggactccgaaaggagggagacgagctcaaccctcgggccttactggcagctcgcagcctagcacggagcccgcgcctgtgcgggcgcctggagctgcccgctccgccgcagcagccgccgcgcctggccgtacgctgtggccggaccccgcggtcgctcgctcacacacccctcgccgctccgcgcctggctcgcccgcgggggccgagcgcgagcgggcgggcgggggaggtgaggggtgcgggcgggtgtgcatgtgcctggctgggtgcacaccccgcaaggcggcggcgccaggacgcggagcgctccccagagcccggctgcctcgcacagctcccgcggctgcgaccatgttccagcccgcggccaagcgcggctttaccatagagtccttggtggccaaggacggcggcaccggcgggggcactggcggcgggggcgcgggctcccatctcctggcggcggccgcctccgaggaaccgctccggcccacggcgctcaactaccctcaccccagcgcggccgaggcggccttcgtgagtggcttccctgccgcggccgccgcgggcgcgggccgctcgctctacggtgggcccgagctcgtgttccccgaggccatgaaccaccccgcgctgaccgtgcatccggcgcaccagctgggcgcctccccgctgcagcccccgcactccttcttcggcgcccagcaccgggaccctctccatttctacccctgggtcctgcggaaccgcttcttcggccaccgcttccaggccagcgacgtgccccaggacgggctgcttctgcacggccccttcgcacgcaagcccaagcggatccgcacggccttctcgccctcgcagctgctgcggctggagcgcgccttcgagaagaaccactacgtggtgggcgccgagcggaagcagctggccggcagtctcagcctctccgagacgcaggtgaaggtgtggttccagaaccggaggacaaagtacaaacggcagaagctggaggaggaagggcctgagtccgagcagaagaagaagggctcccatcacatcaaccggtggcgcattgccacgaagcaggccaatggggaggacatcgatgtcacctccaatgactagggtgggcaaccacaaacccacgagggcagagtgctgcttgctgctggccaggcccctgcgtgggcccaagctggactctggccactccctggccaggctttggggaggcctggagtcatggccccacagggcttgaagcccggggccgccattgacagagggacaagcaatgggctggctgaggcctgggaccacttggccttctcctcggagagcctgcctgcctgggcgggcccgcccgccaccgcagcctcccagctgctctccgtgtctccaatctcccttttgttttgatgcatttctgttttaatttattttccaggcaccactgtagtttagtgatccccagtgtcccccttccctatgggaataataaaagtctctctcttaatgacacgggcatccagctccagccccagagcctggggtggtagattccggctctgagggccagtgggggctggtagagcaaacgcgttcagggcctgggagcctggggtggggtactggtggagggggtcaagggtaattcattaactcctctcttttgttgggggaccctggtctctacctccagctccacagcaggagaaacaggctagacatagggaagggccatcctgtatcttgagggaggacaggcccaggtctttcttaacgtattgagaggtgggaatcaggcccaggtagttcaatgggagagggagagtgcttccctctgcctagagactctggtggcttctccagttgaggagaaaccagaggaaaggggaggattggggtctgggggagggaacaccattcacaaaggctgacggttccagtccgaagtcgtgggcccaccaggatgctcacctgtccttggagaaccgctgggcaggttgagactgcagagacagggcttaaggctgagcctgcaaccagtccccagtgactc

SEQ ID NO: 9476 - DNA, 3281 bp, Homo sapiens
gcgggcgccgcaggagcgagtgagctgggagcgaggggcgaaggcgcggagaagcccggccgcccggtgggcggcagaaggctcagccgaggcggcggcgccgactccgttccactctcggcccggatccaggcctccgggttcccaggcgctcacctccctctgacgcactttaaagagtctccccccttccacctcagggcgagtaatagcgaccaatcatcaagccatttaccaggcttcggaggaagctgtttatgtgatccccgcactaattaggctcatgaactaacaaatcgtttgcacaacttgtgaagaagcgaacacttccatggattgtccttggacttagggcgccctgcccgccttttgcagaggagaaaaaacttttttttttttttgcctcccccgagaactttccccccttctcctccctgcctctaactccgatccccccacgccatctcgccaaaaaaaaaaaaaaaaaaaaaaaagaaaaaaaaagaaaaaaaaagaaaaaaaattaccccaatccacgcctgcaaattcttctggaaggattttcccccctctcttcaggttgggcgcgtttggtgcaagattctcgggatcctcggctttgcctctccctctccctcccccctcctttcctttttcctttcctttcctttctttcttcctttccttccccccacccccacccccaccccaaacaaacgagtccccaattctcgtccgtcctcgccgcgggcagcgggcggcggaggcagcgtgcggcggtcgccaggagctgggagcccagggcgcccgctcctcggcgcagcatgttccagccggcgcccaagcgctgcttcaccatcgagtcgctggtggccaaggacagtcccctgcccgcctcgcgctccgaggaccccatccgtcccgcggcactcagctacgctaactccagccccataaatccgttcctcaacggcttccactcggccgccgccgccgccgccggtaggggcgtctactccaacccggacttggtgttcgccgaggcggtctcgcacccgcccaaccccgccgtgccagtgcacccggtgccgccgccgcacgccctggccgcccaccccctaccctcctcgcactcgccacaccccctattcgcctcgcagcagcgggatccgtccaccttctacccctggctcatccaccgctaccgatatctgggtcatcgcttccaagggaacgacactagccccgagagtttccttttgcacaacgcgctggcccgaaagcccaagcggatccgaaccgccttctccccgtcccagcttctaaggctggaacacgcctttgagaagaatcactacgtggtgggcgccgaaaggaagcagctggcacacagcctcagcctcacggaaactcaggtaaaagtatggtttcagaaccgaagaacaaagttcaaaaggcagaagctggaggaagaaggctcagattcgcaacaaaagaaaaaagggacgcaccatattaaccggtggagaatcgccaccaagcaggcgagtccggaggaaatagacgtgacctcagatgattaaaaacataaacctaaccccacagaaacggacaacatggagcaaaagagacagggagaggtggagaaggaaaaaaccctacaaaacaaaaacaaaccgcatacacgttcaccgagaaagggagagggaatcggagggagcagcggaatgcggcgaagactctggacagcgagggcacagggtcccaaaccgaggccgcgccaagatggcagaggatggaggctccttcatcaacaagcgaccctcgtctaaagaggcagctgagtgagagacacagagagaaggagaaagagggagggagagagagaaagagagagaaagagagagagagagagagagagagaaagctgaacgtgcactctgacaaggggagctgtcaatcaaacaccaaaccggggagacaagatgattggcaggtattccgtttatcacagtccacttaaaaaatgatgatgatgataaaaaccacgacccaaccaggcacaggacttttttgttttttgcacttcgctgtgtttcccccccatctttaaaaataattagtaataaaaaacaaaaattccatatctagccccatcccacacctgtttcaaatccttgaaatgcatgtagcagttgttgggcgaatggtgtttaaagaccgaaaatgaattgtaattttcttttccttttaaagacaggttctgtgtgctttttattttgattttttttcccaagaaatgtgcagtctgtaaacactttttgataccttctgatgtcaaagtgattgtgcaagctaaatgaagtaggctcagcgatagtggtcctcttacagagaaacggggagcaggacgacgggggggctgggggtggcgggggagggtgcccacaaaaagaatcaggacttgtactgggaaaaaaacccctaaattaattatatttcttggacattccctttcctaacatcctgaggcttaaaaccctgatgcaaacttctcctttcagtggttggagaaattggccgagttcaaccattcactgcaatgcctattccaaactttaaatctatctattgcaaaacctgaaggactgtagttagcggggatgatgttaagtgtggccaagcgcacggcggcaagttttcaagcactgagtttctattccaagatcatagacttactaaagagagtgacaaatgcttccttaatgtcttctataccagaatgtaaatatttttgtgttttgtgttaatttgttagaattctaacacactatatacttccaagaagtatgtcaatgtcaatattttgtcaataaagatttatcaatatgccctcagagtagtcgtcttgggaaattgaagtggatctttaaaaatgtatctcagtaatttgagtgtggtccttccccaactaggctcaagaaacccaggctcctcacccacaaaagggccagattgatggattctcaggcattttaaagaaagatgagggtggagaagggagaagattaggaaaacttaagtccttcagaaaagagatgggagaaaagtttttcaaccagactttgcccattgtatgccctcctgagggagtttagtttgaacttcaggttaaaatgcttacttctcttaacctctggttattaaaaaaaaactggacatatagttacacattgaggactactctcccaaaatattggggaaaacatgtagcagaatct

SEQ ID NO: 9477 - DNA, 2710 bp, Homo sapiens
cgggcgccgcaggagcgagtgagctgggagcgaggggcgaaggcgcggagaagcccggccgcccggtgggcggcagaaggctcagccgaggcggcggcgccgactccgttccactctcggcccggatccaggcctccgggttcccaggcgctcacctccctctgacgcactttaaagagtctccccccttccacctcagggcgagtaatagcgaccaatcatcaagccatttaccaggcttcggaggaagctgtttatgtgatccccgcactaattaggctcatgaactaacaaatcgtttgcacaacttgtgaagaagcgaacacttccatggattgtccttggacttagggcgccctgcccgccttttgcagaggagaaaaaacttttttttttttttgcctcccccgagaactttccccccttctcctccctgcctctaactccgatccccccacgccatctcgccaaaaaaaaaaaaaaaaaaaaaaaagaaaaaaaaagaaaaaaaaagaaaaaaaattaccccaatccacgcctgcaaattcttctggaaggattttcccccctctcttcaggttgggcgcgtttggtgcaagattctcgggatcctcggctttgcctctccctctccctcccccctcctttcctttttcctttcctttcctttctttcttcctttccttccccccacccccacccccaccccaaacaaacgagtccccaattctcgtccgtcctcgccgcgggcagcgggcggcggaggcagcgtgcggcggtcgccaggagctgggagcccagggcgcccgctcctcggcgcagcatgttccagccggcgcccaagcgctgcttcaccatcgagtcgctggtggccaaggacagtcccctgcccgcctcgcgctccgaggaccccatccgtcccgcggcactcagctacgctaactccagccccataaatccgttcctcaacggcttccactcggccgccgccgccgccgccggtaggggcgtctactccaacccggacttggtgttcgccgaggcggtctcgcacccgcccaaccccgccgtgccagtgcacccggtgccgccgccgcacgccctggccgcccaccccctaccctcctcgcactcgccacaccccctattcgcctcgcagcagcgggatccgtccaccttctacccctggctcatccaccgctaccgatatctgggtcatcgcttccaaggtaaaagtatggtttcagaaccgaagaacaaagttcaaaaggcagaagctggaggaagaaggctcagattcgcaacaaaagaaaaaagggacgcaccatattaaccggtggagaatcgccaccaagcaggcgagtccggaggaaatagacgtgacctcagatgattaaaaacataaacctaaccccacagaaacggacaacatggagcaaaagagacagggagaggtggagaaggaaaaaaccctacaaaacaaaaacaaaccgcatacacgttcaccgagaaagggagagggaatcggagggagcagcggaatgcggcgaagactctggacagcgagggcacagggtcccaaaccgaggccgcgccaagatggcagaggatggaggctccttcatcaacaagcgaccctcgtctaaagaggcagctgagtgagagacacagagagaaggagaaagagggagggagagagagaaagagagagaaagagagagagagagagagagagagaaagctgaacgtgcactctgacaaggggagctgtcaatcaaacaccaaaccggggagacaagatgattggcaggtattccgtttatcacagtccacttaaaaaatgatgatgatgataaaaaccacgacccaaccaggcacaggacttttttgttttttgcacttcgctgtgtttcccccccatctttaaaaataattagtaataaaaaacaaaaattccatatctagccccatcccacacctgtttcaaatccttgaaatgcatgtagcagttgttgggcgaatggtgtttaaagaccgaaaatgaattgtaattttcttttccttttaaagacaggttctgtgtgctttttattttgattttttttcccaagaaatgtgcagtctgtaaacactttttgataccttctgatgtcaaagtgattgtgcaagctaaatgaagtaggctcagcgatagtggtcctcttacagagaaacggggagcaggacgacgggggggctgggggtggcgggggagggtgcccacaaaaagaatcaggacttgtactgggaaaaaaacccctaaattaattatatttcttggacattccctttcctaacatcctgaggcttaaaaccctgatgcaaacttctcctttcagtggttggagaaattggccgagttcaaccattcactgcaatgcctattccaaactttaaatctatctattgcaaaacctgaaggactgtagttagcggggatgatgttaagtgtggccaagcgcacggcggcaagttttcaagcactgagtttctattccaagatcatagacttactaaagagagtgacaaatgcttccttaatgtcttctataccagaatgtaaatatttttgtgttttgtgttaatttgttagaattctaacacactatatacttccaagaagtatgtcaatgtcaatattttgtcaataaagatttatcaatatgccctc

SEQ ID NO: 9478 - DNA, 1317 bp, Homo sapiens
aaaaggccggtacctcgggcaagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccaggtgattggcgaggacaacgtggcagtcccctcacacctttataaggtaatcctggcccgcagaagctcagtatctaccgaaccactggcgctaggggcctttgtggtacccaatgaagccatcggcttccagccccagttaactgaattccaagtgagcctccaggacctagagaagttgtcaggactggtgttttttcctcatttggatagaactagtgatatccggaatatctgctctgtggacacctgtaagctcctggatttccaggagttcaccttgtacttgagtacaagaaagattgaaggagcccgatcagtgctcagactggaaaagatcatggaaaacttgaagaatgcagagattgaaccagatgattactttatgagtcgctatgagaagaagctagaagaactcaaagctaaggagcagtcaggaacccagataagaaagccatcctagtttttatctcaagatgtgtcataccgtctgtaatgaagcaggcatgccctctttaggctaacatattttagtggctttgctttttgctttttaaaaagtttttctctttaagagatgtggtctcgccgtgtcatccaggctggagtgcagtggtggaatcatagctcactatagcctcaaacttctgggcttaagcaatcctcctgcctctgccccctgagcagctgggactacaggcacacaccatcaccctcagctactagtggctttgctttaaagaaacagtggaatcctaaatttatgactaaaaattcccccaaaagatgaaagatctaca

SEQ ID NO: 9479 - DNA, 2792 bp, Homo sapiens
agcttggcgggcggtgaggcgtggggtgacggggggatggcgggggccggcatgcgcgcgcatgcgccgtggtaaaaggccggtacctcgggcaagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatggatctgcagaaaaggctgtcttggaacaatttggattccctttaactggaacagaggcaaggtgttacactaatcacgctttgtcttatgatcaggcaaagcgggtgcctagatgggttcttgaacatatttccaaaagcaagataatgggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccaggtgattggcgaggacaacgtggcagtcccctcacacctttataaggtaatcctggcccgcagaagctcagtatctaccgaaccactggcgctaggggcctttgtggtacccaatgaagccatcggcttccagccccagttaactgaattccaagtgagcctccaggacctagagaagttgtcaggactggtgttttttcctcatttggatagaactagtgatatccggaatatctgctctgtggacacctgtaagctcctggatttccaggagttcaccttgtacttgagtacaagaaagattgaaggagcccgatcagtgctcagactggaaaagatcatggaaaacttgaagaatgcagagattgaaccagatgattactttatgagtcgctatgagaagaagctagaagaactcaaagctaaggagcagtcaggaacccagataagaaagccatcctagtttttatctcaagatgtgtcataccgtctgtaatgaagcaggcatgccctctttaggctaacatattttagtggctttgctttttgctttttaaaaagtttttctctttaagagatgtggtctcgccgtgtcatccaggctggagtgcagtggtggaatcatagctcactatagcctcaaacttctgggcttaagcaatcctcctgcctctgccccctgagcagctgggactacaggcacacaccatcaccctcagctactagtggctttgctttaaagaaacagtggaatcctaaatttatgactaaaaattcccccaaaagatgaaagatctacaatgtttttgtcagtattatatttgactcaggaactaattattaagggagctttgacacctgcagatggagggctgatcttgtgtcaagttaacaggaagactgcccacagatgacactgcatttgtatccctgtggatgtagagtattgggaaggcatttgtttagtttcatgcctccaaaccatgcattgtctgtgatgtatctgcccagccttctcagaactcaatgttgtacatttttccctctaggacctgaattggtcttggaggcagcttttagaaatcctctgtgtagttcctgtccacatgcactatatatttgtttcttttttctcctctcatgaatctgctcgtttctctacttctgtctacgtagaagcactcagcaactagtttctgctcattaaatgtgttctatatactaggctcagtgctttacatgtgttgtctcacaatgactctctgaggtaaatacactatccccattttacctgtgagaaaattgaggcttagagagcttagtgtcttacctgagtttcacttttccaaagtagtcatccacaaagtatgaggcagacagatctaagagaagaaagacagctgaggtagattcaaatcttttctgacatggatggtggctttttactcagaaatatatacctatttccatgggtatttgtgggcctgaggcatgcttggcaagaagagtctggtttctcgtctgctatgcaagccaaagggactttaatgttctttgaattgaaccctccttagctctgtggaaagagacagtcaggaatatttgggaattagacggcaatactttgtggggtttattagagcccatgcttgcctccagagatacagttcttttagtgaccagatactgccaaattgatgtgttcttgctttccaggtgagctttttgttcttaagattaagaaacctatgaaggatctgcagccaggcatggtggctcaggcctataatctcagcactttgggaaatcgaggtgggtggatcgcttgagcccaggagtttgagaccagcctgggcaacataatgaaaccctatctttacaaaaaaatacaaaaattagctgggcgtggtggtgcacacctgtagtcccagctactcgggaggctgaaatgggaggattgcttgagcctggcaggtcaaggctgcgatgggacatggtcatgccactggacgccagcctgggccacagagggagaccctgtctcaaaaaaag

SEQ ID NO: 9480 - DNA, 966 bp, Homo sapiens
agcttggcgggcggtgaggcgtggggtgacggggggatggcgggggccggcatgcgcgcgcatgcgccgtggtaaaaggccggtacctcgggcaagatggctatcaagagtatcgcttcccgcctccggggttcccgtcgttttctgagcggcttcgtggctggggctgtagtgggcgctgcgggagctgggctcgcggccctgcagttcttccggagtcagggcgctgagggagcgttgacagggaagcagccggatggatctgcagaaaaggctgtcttggaacaatttggattccctttaactggaacagaggcaaggtgttacactaatcacgctttgtcttatgatcaggcaaagcgggtgcctagatgggttcttgaacatatttccaaaagcaagataatgggtgatgcagacagaaagcattgtaaatttaagcctgatcccaatatccctccaaccttcagtgccttcaatgaagattatgttggaagtgggtggtcacgaggacacatggctccagcaggaaataacaaattttcaagtaaagccatggctgaaaccttttacctttctaacattgtgcctcaggattttgataataattctggatattggaacagaatagaaatgtactgtcgagagctgacagaaaggtttgaagatgtttgggtggtatctgggcctttgaccttacctcagactagaggcgatggaaagaaaatagttagttaccaggtgattggcgaggacaacgtggcagtcccctcacacctttataaggaccacgctggctgctgtgttgagagcccgctggggacaaggaccagtgaggaggccactgcaagaatccaggagagagatgatggcggctcagaccagcgcagtggcctggttgaacttgggatatatttcgaaggtagagccaacaggatttccggccggattggatgtagggtgtga

SEQ ID NO: 9481 - DNA, 1679 bp, Homo sapiens
gaaaggcagggaggggaggttgtcccctgctgagaaccattggtttaaggttaatctggctctgctttcatagactactctgttacccaggctggagtgcggtgatgagtgatcatagctcactgcagccttaaactctagtgatcctcccgccttggccttccaaagtgctgagattacagatgtgaaccaccacacccagcccagtcaatttgtttttagaatgttcccaagaatatagttatgttgctaaataagatactaaaataatcccatactatatttcttgacagaaaaactattaaaatgtatacatgataaaaatttcttttatgaagcaaaatatgttttgttttgctcatgaacgtgaggtattttggaaaaatggtaaagaagtgcagagtcaagtcatagcgactaataatgggttattttcttaaattgtatgcttatgttaattctcacagtctttttgtttgggtctgtgacagatcttacaaaagatcttttagacctatgattcttaacaaaattaaagaattaagtcggaaccaattttccacaatgtctcatctaagaaaggactcacagcccagcagcccaggagatgacgcaatggacaggagtgggctccctgaccttcaaggaagatttgagctatctgggaaaaacagacagtatccactggatgcattggaaccccaacccagcattggggatattaaggacattaaaaaagcagccaagtctatgctagacccagcacataaatctcatttccaccctgtgaccccaagtttagtattcttgtgtttcatatttgatgggttacaccaggcattactgagtgttggtgtgagcaagaggtctaatactgtggttgggaatgagaacgaggaaaggggtactccttatgctagcagattcaaagatatgcctaactttattgcccttgagaagtcatcagttctccgccactgctgtgaccttttgataggcattgcggctggatcaagtgataagatttgcaccagcagtctccaagttcagagacgattcaaggcaatgatggcatctattggaagactttcacatggtgagagtgctgatctgctaatcagctgcaatgcagaatcagccataggttggatcagctcaagaccatgggttggagaattaatgttcacacttctatttggagactttgaatcccctctacacaagctacgcaagtcaagttagttgccaagaaagcacagatgacaacctattaatgctgtgagaatgtttctagatcagtgcatggatggctccattgctctacgggccattgtgtctgagatcccagtctttgaggagaaaaaaaacaatggttaaaaaggcattggggaaatattttgagtttgggggtgtactttgccaccccattattggggagctgtcaccacgaatgttcccaaacttagcaacagcggcaaactactgggccaagatgagcaaccccacatttttgggatttaaagctcctgatgttataccaggatcaaccatcacactccctttgcttcaaatggcatctaccccgtaagatcttgaggggggagtgttgggtggaatcatagatccatgcactcctaacatgaactaattctcattatttaaaaaaaaaaaaaaaaaaa

SEQ ID NO: 9482 - DNA, 1172 bp, Homo sapiens
aaatgcgcaaagaaaggacgccggggacacccggttgggctctgctgctcccttctgggttccgaggcccaagcccttggcagtgtttgtgagtggaagggaggtcacgctatcgtccgcggccccagcagccctgtgccctcgttggatcccgcgacgcggctcctttaagagcctcgcgggtcgcccgccgctaggtcgctccccggccatgcgggcgctgcgggccggcctgaccctggcgtcgggcgcggggctgggtgcggtcgtcgagggctggcggcggcggcgggaggacgcgcgggcggcgccgggactgctgggccggctgcccgtgctgcccgtggcggcggcagccgagttgccccctgtgcccgggggaccccgcggcccgggcgagctggccaagtacgggctgccggggctggcgcagctcaagagccgcgagtcgtacgtgctgtgctacgacccgcgcacccgcggcgcgctctgggtggtggagcagctgcgacccgagcgtctccgcggcgacggcgaccggcgcgagtgcgacttccgcgaggacgactcggtgcacgcgtaccaccgtgccaccaacgccgactaccgcggcagtggcttcgaccgcggtcacctggccgccgccgccaaccaccgctggagccagaaggccatggacgacacgttctacctgagcaacgtcgcgccccaggtgccccacctcaaccagaatgcctggaacaacctggagaaatatagccgcagcttgacccgcagctaccaaaacgtctatgtctgcacagggccactcttcctgcccaggacagaggctgatgggaaatcctacgtaaagtaccaggtcatcggcaagaaccacgtggcagtgcccacacacttcttcaaggtgctgatcctggaggcagcaggtgggcaaattgagctccgcacctacgtgatgcccaacgcacctgtggatgaggccatcccactggagcgcttcctggtgcccatcgagagcattgagcgggcttcggggctgctctttgtgccaaacatcctggcgcgggcaggcagcctcaaggccatcacggcgggcagtaagtgagggtggagcccagtgagactgtgggtgtgtgcaggccggggagtattaaaggtggtgatttttggag

SEQ ID NO: 9483 - DNA, 5488 bp, Homo sapiens
accaattcccttcctgggagttgcggcttccctcgctcggccccactcccgtttaccctttccccagctcccgccttagccaggggcttccccgcctgccgctagggctcgggccgaagcgccgctcagcgccagcctgccgctccccgggctccactttcactttcggtcctgggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagtgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaagggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcgagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacatgatcctgaagctgacgcaacaggatgaaaatccatcagaatctcagactacagcactaaatatgctttgatgctacatcaaacggaatggaagcatagctgacttcgctaaagttacttcatctccatctagcaaatgaggcactgttctcaaccaaaggagatggggatctggtttagggcaatccctttataatttgatgtgctgtggtctccttggtaatgtataatttggtattgcacaggtgattagtcaaggaagtctggaaaagctttggtcccacagccttgcctcacagcatgtaaataattaaaacaatattgatgctgaggttcttctactgctagtatgaaagtgacaaatttttactggtgtgaattgggaagaaaacaatgctattccatgacgtttgtaaaatgtttgtaaaagctcaaacatgacgattccataaaataaacttgaggttaaataatgggtagtaaattatagaatgtataagaaaaaatataaaggagaaaatcaattatcaggaaagctaaagaacttttcaaatctagtaatttgaatatagacacaatgcactttattgcactttcaattcttataaagcaacaataatattaaggtccttgactatgtgtacaatgttttcacatatatagtttcatttaatcatttcaaagttaatctctgccatctcgctaaatcatcagtctcggctcttctgaaatagaaggtgcctgatcttcctaataattctgcctattttcatttgctttaaacaggcgccctattttctttctagttgtggctgcgcaaaaacatttatctcccaaataagatgtgctgcttaccgaggtatcacggggtggggctccagcttgggtcgttgaagctggggtttgggaaaccacttcagagatggcagcagcaagtttagcatcttcaaatttcttttattgaaaaaaattttattagtaacatgttgtatataaaattatgagcacaatgccatcacttaactataactcttaaagatagcttaatgactgtttattctcttgaccaaatagactcataataacatataattttaaaagaaatttaaattctttcttctctattgtattattttatacaatttgctatttctatttccttctcatattgattattctaaatactatgcaataatataacttagagttccacggtttgtttacacatttcctgttgtacatttaggttattcaaagttttcagctcttttaaaattgctctgaataagttctagtgagtgagttatggtgctggctatattttgctaaactgccctctcaaatgttgctaggaattcatactgcgaaaagcaatgaataagcatgcctgttttcccatggccttgcttgccagaatttgacttttattatgataatcagtgtaaaatgatatactactattgcttgtatattgtggtatacggtgtcaggtttcagggttttttttcaacgttaaatattctagaaactttctgaaataatttctgtttaaaaatattgaatatttgcttcatttcaaatactcccttttgacaaaaaaacttaggtataactgttgatgaaaaaccagaaaaaagtccagaactctttggtgactccaactatggatagcttattttgaaaaaggagaattgcaaattttaccaaaagatggagaaaagcacattaaaaagataccaacattcagaaattcatttcagcatgttattattggaaattatttaaactaatttagataactataagatacttattgtccatttataccctgtaaagccgttttagaatgtaatattttaggtaatccaaaatgtactaaattaaattcatttttagttatgagaaatctttgcttatatgacaaatgaaaagaataacaagttgtcaaatgaaaagaatgacattgaaacatttgtattgtctcttcttaaactatcttattgacttattatttaagccttttaatactaagtatgaaacaacctatggtctggaaatttgtatcgcaaagctatatgtgcatatgttatttaattcatctaatgctacacaaaagcataaaataatgatttttcactctctttaaaaatactaaatcatttatgtccatttctcaattttttcattgatctatgctttgagtttgctttctcaacattattgtattttccacttattattactgtataacatatgctagtgtttagttggattaatcttacctaaaagtactgaaaaatgctttttagtactttttcatattttatacatttattttccgaatgtatcattgaataattttattgagttataaaagtatcttattgctatttaataaaaaattaacacat

SEQ ID NO: 9484 - DNA, 3122 bp, Homo sapiens
actttcggtcctgggggagctaggccggcggcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagtgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaagggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcgagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtatgtaaaaattcctcccttgccaggttcctgttatctctaatcaccaacattttgttgagtgtattttcaaactagagatggctgttttggctccaactggagatacttttttcccttcaactcattttttgactatccctgtgaaaagaatagctgttagtttttcatgaatggtttaataaaaatagaaatcactggtaattt

SEQ ID NO: 9485 - DNA, 4805 bp, Homo sapiens
gcagtggtggtggcggcggcgcaagggtgagggcggccccagaaccccaggtaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggagcaaattgcactgctggctcccgagcccctccttgtcgggctcccgtacacagttgtcattcactatgctggcaatctttcggagactttccacggattttacaaaagcacctacagaaccaaggaaggggaactgaggatactagcatcaacacaatttgaacccactgcagctagaatggcctttccctgctttgatgaacctgccttcaaagcaagtttctcaatcaaaattagaagagagccaaggcacctagccatctccaatatgccattggtgaaatctgtgactgttgctgaaggactcatagaagaccattttgatgtcactgtgaagatgagcacctatctggtggccttcatcatttcagattttgagtctgtcagcaagataaccaagagtggagtcaaggtttctgtttatgctgtgccagacaagataaatcaagcagattatgcactggatgctgcggtgactcttctagaattttatgaggattatttcagcataccgtatcccctacccaaacaagatcttgctgctattcccgactttcagtctggtgctatggaaaactggggactgacaacatatagagaatctgctctgttgtttgatgcagaaaagtcttctgcatcaagtaagcttggcatcacaatgactgtggcccatgaactggctcaccagtggtttgggaacctggtcactatggaatggtggaatgatctttggctaaatgaaggatttgccaaatttatggagtttgtgtctgtcagtgtgacccatcctgaactgaaagttggagattatttctttggcaaatgttttgacgcaatggaggtagatgctttaaattcctcacaccctgtgtctacacctgtggaaaatcctgctcagatccgggagatgtttgatgatgtttcttatgataagggagcttgtattctgaatatgctaagggagtatcttagtgctgacgcatttaaaagtggtattgtacagtatctccagaagcatagctataaaaatacaaaaaacgaggacctgtgggatagtatggcaagtatttgccctacagatggtgtaaaagggatggatggcttttgctctagaagtcaacattcatcttcatcctcacattggcatcaggaaggggtggatgtgaaaaccatgatgaacacttggacactgcagaagggttttcccctaataaccatcacagtgagggggaggaatgtacacatgaagcaagagcactacatgaagggctctgacggcgccccggacactgggtacctgtggcatgttccattgacattcatcaccagcaaatccgacatggtccatcgatttttgctaaaaacaaaaacagatgtgctcatcctcccagaagaggtggaatggatcaaatttaatgtgggcatgaatggctattacattgtgcattacgaggatgatggatgggactctttgactggccttttaaaaggaacacacacagcagtcagcagtaatgatcgggcgagtctcattaacaatgcatttcagctcgtcagcattgggaagctgtccattgaaaaggccttggatttatccctgtacttgaaacatgaaactgaaattatgcccgtgtttcaaggtttgaatgagctgattcctatgtataagttaatggagaaaagagatatgaatgaagtggaaactcaattcaaggccttcctcatcaggctgctaagggacctcattgataagcagacatggacagacgagggctcagtctcagagcgaatgctgcggagtcaactactactcctcgcctgtgtgcacaactatcagccgtgcgtacagagggcagaaggctatttcagaaagtggaaggaatccaatggaaacttgagcctgcctgtcgacgtgaccttggcagtgtttgctgtgggggcccagagcacagaaggctgggattttctttatagtaaatatcagttttctttgtccagtactgagaaaagccaaattgaatttgccctctgcagaacccaaaataaggaaaagcttcaatggctactagatgaaagctttaagggagataaaataaaaactcaggagtttccacaaattcttacactcattggcaggaacccagtaggatacccactggcctggcaatttctgaggaaaaactggaacaaacttgtacaaaagtttgaacttggctcatcttccatagcccacatggtaatgggtacaacaaatcaattctccacaagaacacggcttgaagaggtaaaaggattcttcagctctttgaaagaaaatggttctcagctccgttgtgtccaacagacaattgaaaccattgaagaaaacatcggttggatggataagaattttgataaaatcagagtgtggctgcaaagtgaaaagcttgaacgtatgtaaaaattcctcccttgccaggttcctgttatctctaatcaccaacattttgttgagtgtattttcaaactagagatggctgttttggctccaactggagatacttttttcccttcaactcattttttgactatccctgtgaaaagaatagctgttagtttttcatgaatgggctatcgctaccatgtgttttgttcatcacaggtgttgccctgcaacgtaaacccaagtgttgggttccctgccacagaagaataaagtaccttattcttctcattttatagtttatgcttaagcacccgtgtccaaaaccctgtaccccatgtttatcattcataaactgtttcatcagtctcctcgaaagactctgaatagtcgactactgaacaatgaacacctggatctgagactaagccggacgatgactgggttaaagctctcccggctcacccctccagacccgctgcccatccctcttccttgctccatgcccaggggctgacttgtaaaggccaagtcatcaagctttcttgccctttggatgttggtcagtggggagccggagagctggagctggggtcggaggaggtagtaggtggaggtgttcttccctgattcccttgcgggatgcctcgggctggcctcccctgagggtcttagctccgagaggggaccctcttttccacacagccttctccacctctggattttggtaactgctccctcctcatcccttcaggattagtggcctcagtgggagtctggcttttactagtcctggcggacttgtggtttctacataatgtgctcgcacttttgcaaaaaatctttttatagaaccctcctcagataattctgagtgagtgtcatctatttccctgactggtacagtatctcttctgaaaaagcagagtgcattcaagtctgtaggaaaacccttttcttagggaggtgattttttttctctctctgcttcttatttggcctactttacaatttctaactaactagttattggcatttactgacagtaaattattgcagtcaccaataaatgatagtacattgtgaaacaaaatatttgctcatattagcaaataggacattctttggctttgaagtctttctttcttttgtgaagacttcacacacggttgcttcagcacacagttgctgctcaggttttatgtatagatgataataatagaaagcacagtttactaacatggtaaaccaacggagttcaagtcaagtcagttaataccctaagaattagattttatttcttattctgaaaacttgctacacagggacttatctaacccatagtgtgctctgttgctgacttgattcaagttgcagcgtgttttgcgctgactctaaggtgcggaaatcctcacacctggcaaaggagaattcaaactgaactttttgaatataaggcaaaaacttcaagataagggaatatgattgatgattggtacgaaaaatgtcaaaatgtgttcccctaatacacgacaaaatagagtgacttctggacataaatctgccatttattaaaccattcactacaacaaataaataggtataaaagtggaattggaatttttatacttatttgttgtagtgaatggtttaataaaaatagaaatcactggtaatttccaccccaaactaaactatttcccttcttttaaaaaaatacacaaccaagattttaatgtaaaatattttgctttaattgtattttatgccttgattaatgaaacatggaaatattgattttcagttttggtcacctgaggaacctatctttgtttgcttttggaaaagcccattttctaaacagatacaatattgccacaacaatgtgcagaaacctttttgataataaaaaattgttctttgcctctaa

SEQ ID NO: 9486 - DNA, 583 bp, Homo sapiens
agctaggccggcggcagtggtggtggcggcggcgcaagggtgagggcggccccagaaccccagacagagtcttgctctgttgccaggctggagtgcagtggtgcaatctcagctcactgcaactctgcctcccaggttcaagcgattctcctgcctcagcctcccaagtaattaggactacaggtagagcaagaagatggtgtttctgcccctcaaatggtcccttgcaaccatgtcatttctactttcctcactgttggctctcttaactgtgtccactccttcatggtgtcagagcactgaagcatctccaaaacgtagtgatgggacaccatttccttggaataaaatacgacttcctgagtacgtcatcccagttcattatgatctcttgatccatgcaaaccttaccacgctgaccttctggggaaccacgaaagtagaaatcacagccagtcagcccaccagcaccatcatcctgcatagtcaccacctgcagatatctagggccaccctcaggaagggagctggagagaggctatcggaagaacccctgcaggtcctggaacacccccgtcaggag

SEQ ID NO: 9487 - DNA, 3219 bp, Homo sapiens
atctgcagcagcatgatttaagattaaattcatgtattgaaaatattgttcagaccccatgtgacataactggagccagtgcagtgccatgaagaactacgagattagcctggatattaacttgtcttctagagaatagatttcatgttccattcttctgcaatggttaattcacacagaaaaccaatgtttaacattcacagaggattttactgcttaacagccatcttgccccaaatatgcatttgttctcagttctcagtgccatctagttatcacttcactgaggatcctggggctttcccagtagccactaatggggaacgatttccttggcaggagctaaggctccccagtgtggtcattcctctccattatgacctctttgtccaccccaatctcacctctctggactttgttgcatctgagaagatcgaagtcttggtcagcaatgctacccagtttatcatcttgcacagcaaagatcttgaaatcacgaatgccacccttcagtcagaggaagattcaagatacatgaaaccaggaaaagaactgaaagttttgagttaccctgctcatgaacaaattgcactgctggttccagagaaacttacgcctcacctgaaatactatgtggctatggacttccaagccaagttaggtgatggctttgaagggttttataaaagcacatacagaactcttggtggtgaaacaagaattcttgcagtaacagattttgagccaacccaggcacgcatggctttcccttgctttgatgaaccgttgttcaaagccaacttttcaatcaagatacgaagagagagcaggcatattgcactatccaacatgccaaaggtgtccatctatgcatccccagacaaacggaatcaaacacattatgctttgcaggcatcactgaagctacttgatttttatgaaaagtactttgatatctactatccactctccaaactggatttaattgctattcctgactttgcacctggagccatggaaaattggggcctcattacatatagggagacgtcactgctttttgaccccaagacctcttctgcttccgataaactgtgggtcaccagagtcatagcccatgaactggcgcaccagtggtttggcaacctggtcacaatggaatggtggaatgatatttggcttaaggagggttttgcaaaatacatggaacttatcgctgttaatgctacatatccagagctgcaatttgatgactattttttgaatgtgtgttttgaagtaattacaaaagattcattgaattcatcccgccctatctccaaaccagcggaaaccccgactcaaatacaggaaatgtttgatgaagtttcctataacaagggagcttgtattttgaatatgctcaaggattttctgggtgaggagaaattccagaaaggaataattcagtacttaaagaagttcagctatagaaatgctaagaatgatgacttgtggagcagtctgtcaaatagttgtttagaaagtgattttacatctggtggagtttgtcattcggatcccaagatgacaagtaacatgctcgcctttctgggggaaaatgcagaggtcaaagagatgatgactacatggactctccagaaaggaatccccctgctggtggttaaacaagacgggtgttcactccgactgcaacaggagcgcttcctccagggggttttccaggaagaccctgaatggagggccctgcaggagaggtacctgtggcatatcccattgacctactccacgagttcttctaatgtgatccacagacacattctaaaatcaaagacagatactctggatctacctgaaaagaccagttgggtgaaatttaatgtggactcaaatggttactacatcgttcactatgagggtcatggatgggaccaactcattacacagctgaatcagaaccacacacttctcagacctaaggacagagtaggtctgattcatgatgtgtttcagctagttggtgcagggagactgaccctagacaaagctcttgacatgacttactacctccaacatgaaacaagcagccccgcacttctcgaaggtctgagttacttggaatcgttttaccacatgatggacagaaggaatatttcagatatctctgaaaacctcaagcgttaccttcttcagtattttaagccagtgattgacaggcaaagctggagtgacaagggctcagtctgggacaggatgctccgctcggctctcttgaagctggcctgtgacctgaaccatgctccttgcatccagaaagctgctgaactcttctcccagtggatggaatccagtggaaaattaaatataccaacagatgttttaaagattgtgtattctgtgggtgctcagacaacagcaggatggaattaccttttagagcaatatgaactgtcaatgtcaagtgctgaacaaaacaaaattctgtatgctttgtcaacgagcaagcatcaggaaaagttactgaagttaattgaactaggaatggaaggaaaggttatcaagacacagaacttggcagctctccttcatgcgattgccagacgtccaaaggggcagcaactagcatgggattttgtaagagaaaattggacccatcttctgaaaaaatttgacttgggctcatatgacataaggatgatcatctctggcacaacagctcacttttcttccaaggataagttgcaagaggtgaaactattttttgaatctcttgaggctcaaggatcacatctggatatttttcaaactgttctggaaacgataaccaaaaatataaaatggctggagaagaatcttccgactctgaggacttggctaatggttaatacttaaatggtcaatagaaaaagtaggctgggcgcggtggctcacgcctgtaatcccagcactttgggaggctgagaagggcggatcacgaggtcaggagatggagaccatcctggctaacacggtgagaccccgtctccgctaaaaatacaaaaaattagccgggcatggtggcaggtgcctgtagtcccagctactcggcaggctgcagcaggaaaatggcataaacccgggaggtggagcttgcagtgagccgagattgcaccactgcattccagcctgggtgactgagcgagactctgtctcaaaaaaaaaaaaaaaaaaaaaaagaaa

SEQ ID NO: 9488 - DNA, 5705 bp, Homo sapiens
cccaactcaaacaggcagataaagagagatcaaagagatgagcatgagatacagtcccctcgtgcccaaggagacagggtggttacagacatggaaaatctgagaataatcacctctgataaagatcacagaagctgcccgggaggtgtttggtaagcttggagttacgtttgtggggtggatgggcagaagtcagatttcatagcactgaggatgcagcacaaggagaagttcaagatcaattcctaagacaacaacttggcactaaaaaacataaactatgttctgaaggctttaccctggggacaagggaagggaggtgataacagcagaagtggcagccactggcgatcctttctttccatggtttggcttctactccaaagccacttatttgtgcattctacaaaaagtttcttgtcctttttgaaataaagctcttatcctaagctccattcacacctgcgtgataatgaaccagctagtacttactgtactcaggaagcatgcaaagttctgaatcttagaacagaaagtgaaagcaaaagtaaattccccttcagtcaaatctgcagcagcatgatttaagattaaattcatgtattgaaaatattgttcagaccccatgtgacataactggagccagtgcagtgccatgaagaactacgagattagcctggatattaacttgtcttctagagaatagatttcatgttccattcttctgcaatggttaattcacacagaaaaccaatgtttaacattcacagaggattttactgcttaacagccatcttgccccaaatatgcatttgttctcagttctcagtgccatctagttatcacttcactgaggatcctggggctttcccagtagccactaatggggaacgatttccttggcaggagctaaggctccccagtgtggtcattcctctccattatgacctctttgtccaccccaatctcacctctctggactttgttgcatctgagaagatcgaagtcttggtcagcaatgctacccagtttatcatcttgcacagcaaagatcttgaaatcacgaatgccacccttcagtcagaggaagattcaagatacatgaaaccaggaaaagaactgaaagttttgagttaccctgctcatgaacaaattgcactgctggttccagagaaacttacgcctcacctgaaatactatgtggctatggacttccaagccaagttaggtgatggctttgaagggttttataaaagcacatacagaactcttggtggtgaaacaagaattcttgcagtaacagattttgagccaacccaggcacgcatggctttcccttgctttgatgaaccgttgttcaaagccaacttttcaatcaagatacgaagagagagcaggcatattgcactatccaacatgccaaaggttaagacaattgaacttgaaggaggtcttttggaagatcactttgaaactactgtaaaaatgagtacataccttgtagcctacatagtttgtgatttccactctctgagtggcttcacttcatcaggggtcaaggtgtccatctatgcatccccagacaaacggaatcaaacacattatgctttgcaggcatcactgaagctacttgatttttatgaaaagtactttgatatctactatccactctccaaactggatttaattgctattcctgactttgcacctggagccatggaaaattggggcctcattacatatagggagacgtcactgctttttgaccccaagacctcttctgcttccgataaactgtgggtcaccagagtcatagcccatgaactggcgcaccagtggtttggcaacctggtcacaatggaatggtggaatgatatttggcttaaggagggttttgcaaaatacatggaacttatcgctgttaatgctacatatccagagctgcaatttgatgactattttttgaatgtgtgttttgaagtaattacaaaagattcattgaattcatcccgccctatctccaaaccagcggaaaccccgactcaaatacaggaaatgtttgatgaagtttcctataacaagggagcttgtattttgaatatgctcaaggattttctgggtgaggagaaattccagaaaggaataattcagtacttaaagaagttcagctatagaaatgctaagaatgatgacttgtggagcagtctgtcaaatagttgtttagaaagtgattttacatctggtggagtttgtcattcggatcccaagatgacaagtaacatgctcgcctttctgggggaaaatgcagaggtcaaagagatgatgactacatggactctccagaaaggaatccccctgctggtggttaaacaagacgggtgttcactccgactgcaacaggagcgcttcctccagggggttttccaggaagaccctgaatggagggccctgcaggagaggtacctgtggcatatcccattgacctactccacgagttcttctaatgtgatccacagacacattctaaaatcaaagacagatactctggatctacctgaaaagaccagttgggtgaaatttaatgtggactcaaatggttactacatcgttcactatgagggtcatggatgggaccaactcattacacagctgaatcagaaccacacacttctcagacctaaggacagagtaggtctgattcatgatgtgtttcagctagttggtgcagggagactgaccctagacaaagctcttgacatgacttactacctccaacatgaaacaagcagccccgcacttctcgaaggtctgagttacttggaatcgttttaccacatgatggacagaaggaatatttcagatatctctgaaaacctcaagcgttaccttcttcagtattttaagccagtgattgacaggcaaagctggagtgacaagggctcagtctgggacaggatgctccgctcggctctcttgaagctggcctgtgacctgaaccatgctccttgcatccagaaagctgctgaactcttctcccagtggatggaatccagtggaaaattaaatataccaacagatgttttaaagattgtgtattctgtgggtgctcagacaacagcaggatggaattaccttttagagcaatatgaactgtcaatgtcaagtgctgaacaaaacaaaattctgtatgctttgtcaacgagcaagcatcaggaaaagttactgaagttaattgaactaggaatggaaggaaaggttatcaagacacagaacttggcagctctccttcatgcgattgccagacgtccaaaggggcagcaactagcatgggattttgtaagagaaaattggacccatcttctgaaaaaatttgacttgggctcatatgacataaggatgatcatctctggcacaacagctcacttttcttccaaggataagttgcaagaggtgaaactattttttgaatctcttgaggctcaaggatcacatctggatatttttcaaactgttctggaaacgataaccaaaaatataaaatggctggagaagaatcttccgactctgaggacttggctaatggttaatacttaaatggtcaatagaaaaagtaggctgggcgcggtggctcacgcctgtaatcccagcactttgggaggctgagaagggcggatcacgaggtcaggagatggagaccatcctggctaacacggtgagaccccgtctccgctaaaaatacaaaaaattagccgggcatggtggcaggtgcctgtagtcccagctactcggcaggctgcagcaggaaaatggcataaacccgggaggtggagcttgcagtgagccgagattgcaccactgcattccagcctgggtgactgagcgagactctgtctcaaaaaaaaaaaaaaaaaaaaaaagaaaaagaaaaagaaaagaaaagaaaaggtacatcagacatgactgcctgcatgaagtcaaacagggtaacaccagtgaagctcaagtcaagagctgtggatattttgtctaaccaacaagaagtctcaagaaatcaggcagtgcagctgcctgctctcagctatcgtatccagccaaaagatgcatgatgatggagtggtgggggaaggccagttcagtatcctatttaaaagtaaacttcctgaataatggatatatgtggagatacagacatagatatatagatacagctgtaattatttagcctcaagtgactttctccattgcttcacgctatgccactattttgcttctttaatttttttaaccttgcttagtattctatagtttgcccaaccagttttacgtccaaggaaaattagccaatgcataaaatatacaaactatgaaaggcaaggatcaggaaaccagagactttgccaccaaatctcagattattagaaactaggtgtcagggtttatcaagaaggccaggaaggccttttgggttaagccttacattcatgaagaacctcaagggtagatttttgagagcattccaaatgaatggtctctggtcaaatgaatgaatggtcaaatgaataaatctgccctcacagagatacaaaaggaaaaggaatataattcataccatttggtttaagccttacattcatgaagtacctcaagggtagatttttgagatcattccaaatgaagtcgaatctgccctcacagagacacaagaaaggaatataattcatacactattgcatttttaataaatcttttgaaatttgcagaattagattgtattgtgtattttcggttaaatgataattgaatgtaaatatttagatgcagcaccatattttataacccagctttagcatttcttcatattttaaggaaaccccccacctccttcttttaagggcgcttcttgctctctgaaatgccctgctaaatgcttctcttaattatttgaataaggtagtttggaataaagaaagaaaagatcactctacatacagatagtaaacttaatttgtgatcctatatatgagacagtataaaaatacagataagttttagaaagactcaaaacaatatgtaaatgactgatgtttgcattattaaggaagacttgggatgttgggtcaagaggggaaagtgttagtcaatccactttggagcaatatcatgaaggtcaattataattccatatacctttctttgatgccacagtcagagatagaatacagtttgggtggccatggatgtgccccaatacagtacacattttttggttaaatttgttttcagatcatttcatggaatctttgaagtatctttgactctaactttgacttggtggtggaccttccttggtttttataacacctaagagatatcctttagaattacatgtattttagcataaggaaattgaaaaagtaaaacatactggtttttttcaacaagaccatatgtaaattaaatagtgaaatgtgtatgagtttcagtagaactgtaccatcaacaatgtttccataaatatgcagagttctttcttttgtattgttatttacaatattgttaaattgaatgcatttgcaatttctaggattctaaagaattgagtacagaaagtagcaattttattatttgatgataatatgagaattactgtgccaatactgttttgataaataaatagatttttaaaaataaatgtattgtactta

SEQ ID NO: 9489 - DNA, 1275 bp, Homo sapiens
attaaattcatgtattgaaaatattgttcagaccccatgtgacataactggagccagtgcagtgccatgaagaactacgagattagcctggatattaacttgtcttctagagaatagatttcatgttccattcttctgcaatggttaattcacacagaaaaccaatgtttaacattcacagaggattttactgcttaacagccatcttgccccaaatatgcatttgttctcagttctcagtgccatctagttatcacttcactgaggatcctggggctttcccagtagccactaatggggaacgatttccttggcaggagctaaggctccccagtgtggtcattcctctccattatgacctctttgtccaccccaatctcacctctctggactttgttgcatctgagaagatcgaagtcttggtcagcaatgctacccagtttatcatcttgcacagcaaagatcttgaaatcacgaatgccacccttcagtcagaggaagattcaagatacatgaaaccaggaaaagaactgaaagttttgagttaccctgctcatgaacaaattgcactgctggttccagagaaacttacgcctcacctgaaatactatgtggctatggacttccaagccaagttaggtgatggctttgaagggttttataaaagcacatacagaactcttggtggtgaaacaagaattcttgcagtaacagattttgagccaacccaggcacgcatggctttcccttgctttgatgaaccgttgttcaaagccaacttttcaatcaagatacgaagagagagcaggcatattgcactatccaacatgccaaaggttaagacaattgaacttgaaggaggtcttttggaagatcactttgaaactactgtaaaaatgagtacataccttgtagcctacatagtttgtgatttccactctctgagtggcttcacttcatcaggggtcaaggtgtccatctatgcatccccagacaaacggaatcaaacacattatgctttgcaggcatcactgaagctacttgatttttatgaaaagtactttgatatctactatccactctccaaactgggtatgttcaaattccacattattgtcttcatttttgctcataaaacttgctttgatctcttccctctttctctttctatgtgatttaaatgagcactgaggaattcagttagctcaggaaaaaataatttgttcctcagagatgattcttgagtgtagaaaataaaatatttatgacatgccc

SEQ ID NO: 9490 - DNA, 2309 bp, Homo sapiens
gatacagtcccctcgtgcccaaggagacagggtggttacagacatggaaaatctgagaataatcacctctgataaagatcacagaagctgcccgggaggtgtttgattaaattcatgtattgaaaatattgttcagaccccatgtgacataactggagccagtgcagtgccatgaagaactacgagattagcctggatattaacttgtcttctagagaatagatttcatgttccattcttctgcaatggttaattcacacagaaaaccaatgtttaacattcacagaggattttactgcttaacagccatcttgccccaaatatgcatttgttctcagttctcagtgccatctagttatcacttcactgaggatcctggggctttcccagtagccactaatggggaacgatttccttggcaggagctaaggctccccagtgtggtcattcctctccattatgacctctttgtccaccccaatctcacctctctggactttgttgcatctgagaagatcgaagtcttggtcagcaatgctacccagtttatcatcttgcacagcaaagatcttgaaatcacgaatgccacccttcagtcagaggaagattcaagatacatgaaaccaggaaaagaactgaaagttttgagttaccctgctcatgaacaaattgcactgctggttccagagaaacttacgcctcacctgaaatactatgtggctatggacttccaagccaagttaggtgatggctttgaagggttttataaaagcacatacagaactcttggtggtgaaacaagaattcttgcagtaacagattttgagccaacccaggcacgcatggctttcccttgctttgatgaaccgttgttcaaagccaacttttcaatcaagatacgaagagagagcaggcatattgcactatccaacatgccaaaggttaagacaattgaacttgaaggaggtcttttggaagatcactttgaaactactgtaaaaatgagtacataccttgtagcctacatagtttgtgatttccactctctgagtggcttcacttcatcaggggtcaaggtgtccatctatgcatccccagacaaacggaatcaaacacattatgctttgcaggcatcactgaagctacttgatttttatgaaaagtactttgatatctactatccactctccaaactggatttaattgctattcctgactttgcacctggagccatggaaaattggggcctcattacatatagggagacgtcactgctttttgaccccaagacctcttctgcttccgataaactgtgggtcaccagagtcatagcccatgaactggcgcaccagtggtttggcaacctggtcacaatggaatggtggaatgatatttggcttaaggagggttttgcaaaatacatggaacttatcgctgttaatgctacatatccagagctgcaatttgatgactattttttgaatgtgtgttttgaagtaattacaaaagattcattgaattcatcccgccctatctccaaaccagcggaaaccccgactcaaatacaggaaatgtttgatgaagtttcctataacaagggagcttgtattttgaatatgctcaaggattttctgggtgaggagaaattccagaaaggaataattcagtacttaaagaagttcagctatagaaatgctaagaatgatgacttgtggagcagtctgtcaaatagttgtttagaaagtgattttacatctggtggagtttgtcattcggatcccaagatgacaagtaacatgctcgcctttctgggggaaaatgcagaggtcaaagagatgatgactacatggactctccagaaaggaatccccctgctggtggttaaacaagacgggtgttcactccgactgcaacaggagcgcttcctccagggggttttccaggaagaccctgaatggagggccctgcaggagaggtacctgtggcatatcccattgacctactccacgagttcttctaatgtgatccacagacacattctaaaatcaaagacagatactctggatctacctgaaaagaccagttgggtgaaatttaatgtggactcaaatggttactacatcgttcactatgagggtcatggatgggaccaactcattacacagctgaatcagaaccacacacttctcagacctaaggacagagtaggtctgattcatgatgtgtttcagctagttggtgcagggagactgaccctagacaaagctcttgacatgacttactacctccaacatgaaacaagcagcccc

SEQ ID NO: 9491 - DNA, 2433 bp, Homo sapiens
ggcggcggttgggccggtgatacccgggcgctttatagtcccgccgcctcctcctccacctcctcctcctcctcctctcctcctggagcagaggaggttgtggcggtggctggagaaagcggcggcggaggatggaggaaggaggcggcggcgtacggagtctggtcccgggcgggccggtgttactggtcctctgcggcctcctggaggcgtccggcggcggccgagcccttcctcaactcagcgatgacatccctttccgagtcaactggcccggcaccgagttctctctgcccacaactggagttttatataaagaagataattatgtcatcatgacaactgcacataaagaaaaatataaatgcatacttccccttgtgacaagtggggatgaggaagaagaaaaggattataaaggccctaatccaagagagcttttggagccactatttaaacaaagcagttgttcctacagaattgagtcttattggacttacgaagtatgtcatggaaaacacattcggcagtaccatgaagagaaagaaactggtcagaaaataaatattcacgagtactaccttgggaatatgttggccaagaaccttctatttgaaaaagaacgagaagcagaagaaaaggaaaaatcaaatgagattcccactaaaaatatcgaaggtcagatgacaccatactatcctgtgggaatgggaaatggtacaccttgtagtttgaaacagaaccggcccagatcaagtactgtgatgtacatatgtcatcctgaatctaagcatgaaattctttcagtagctgaagttacaacttgtgaatatgaagttgtcattttgacaccactcttgtgcagtcatcctaaatataggttcagagcatctcctgtgaatgacatattttgtcaatcactgccaggatctccatttaagcccctcaccctgaggcagctggagcagcaggaagaaatactaagggtgccttttaggagaaataaagaggaagatttgcaatcaactaaagaagagagatttccagcgatccacaagtcgattgctattggctctcagccagtgctcactgttgggacaacccacatatccaaattgacagatgaccaactcataaaagagtttcttagtggttcttactgctttcgtgggggtgtcggttggtggaaatatgaattctgctatggcaaacatgtacatcaataccatgaggacaaggatagtgggaaaacctctgtggttgtcgggacatggaaccaagaagagcatattgaatgggctaagaagaatactgctagagcttatcatcttcaagacgatggtacccagacagtcaggatggtgtcacatttttatggaaatggagatatttgtgatataactgacaaaccaagacaggtgactgtaaaactaaagtgcaaagaatcagattcacctcatgctgttactgtatatatgctagagcctcactcctgtcaatatattcttggggttgaatctccagtgatctgtaaaatcttagatacagcagatgaaaatggacttctttctctccccaactaaaggatattaaagttaggggaaagaaaagatcattgaaagtcatgataatttctgtcccactgtgtctcattatagagttctcagccattggacctcttctaaaggatggtataaaatgactctcaaccactttgtgaatacatatgtgtatataagaggttattgataaacttctgaggcagacatttgtctcgctttttttcatttttgttgtgtcttataaactgactgtttttctttgcttggatactgtgattccaaaataaatctcatccaagcaagttagagtccagcctaatcaaatgtcataattgttgtacctattgaaagtttttaaataatagatttattatgtaaattatagtatatgtaagtagctaatgaagtaaagatcatgaagaaagaaattgataggtgtaaatgagagaccatgtaaaatatgtaaattctagtacctgaaatcctttcaacagatttttatatagcaactgctctctgcaagtagttaaactagaaactgggcacatggtagaggctcacatgggagttgtcctcacccttgttaatctcaagaaactcttatttataataggttgcttctctctcagaacttttatctattacttttttcttcttatgagtatgtttactctcagagtatctatctgatgtagacagttggtgatgcttctgagactcagaatggtttactctaacaaaacactgtgctgtctatcccttgtacttgcctactgtaatatggatttcacttctgaacagtttacagcacaatatttattttaaagtgaataaaatgtccacaagcagtgttgtcatgtagtcaatggca

SEQ ID NO: 9492 - DNA, 2271 bp, Homo sapiens
ggcggcggttgggccggtgatacccgggcgctttatagtcccgccgcctcctcctccacctcctcctcctcctcctctcctcctggagcagaggaggttgtggcggtggctggagaaagcggcggcggaggatggaggaaggaggcggcggcgtacggagtctggtcccgggcgggccggtgttactggtcctctgcggcctcctggaggcgtccggcggcggccgagcccttcctcaactcagcgatgacatccctttccgagtcaactggcccggcaccgagttctctctgcccacaactggagttttatataaagaagataattatgtcatcatgacaactgcacataaagaaaaatataaatgcatacttccccttgtgacaagtggggatgaggaagaagaaaaggattataaaggccctaatccaagagagcttttggagccactatttaaacaaagcagttgttcctacagaattgagtcttattggacttacgaagtatgtcatggaaaacacattcggcagtaccatgaagagaaagaaactggtcagaaaataaatattcacgagtactaccttgggaatatgttggccaagaaccttctatttgaaaaagaacgagaagcagaagaaaaggaaaaatcaaatgagattcccactaaaaatatcgaaggtcagatgacaccatactatcctgtgggaatgggaaatggtacaccttgtagtttgaaacagaaccggcccagatcaagtactgtgatgtacatatgtcatcctgaatctaagcatgaaattctttcagtagctgaagttacaacttgtgaatatgaagttgtcattttgacaccactcttgtgcagtcatcctaaatataggttcagagcatctcctgtgaatgacatattttgtcaatcactgccaggatctccatttaagcccctcaccctgaggcagctggagcagcaggaagaaatactaagggtgccttttaggagaaataaagagggtgtcggttggtggaaatatgaattctgctatggcaaacatgtacatcaataccatgaggacaaggatagtgggaaaacctctgtggttgtcgggacatggaaccaagaagagcatattgaatgggctaagaagaatactgctagagcttatcatcttcaagacgatggtacccagacagtcaggatggtgtcacatttttatggaaatggagatatttgtgatataactgacaaaccaagacaggtgactgtaaaactaaagtgcaaagaatcagattcacctcatgctgttactgtatatatgctagagcctcactcctgtcaatatattcttggggttgaatctccagtgatctgtaaaatcttagatacagcagatgaaaatggacttctttctctccccaactaaaggatattaaagttaggggaaagaaaagatcattgaaagtcatgataatttctgtcccactgtgtctcattatagagttctcagccattggacctcttctaaaggatggtataaaatgactctcaaccactttgtgaatacatatgtgtatataagaggttattgataaacttctgaggcagacatttgtctcgctttttttcatttttgttgtgtcttataaactgactgtttttctttgcttggatactgtgattccaaaataaatctcatccaagcaagttagagtccagcctaatcaaatgtcataattgttgtacctattgaaagtttttaaataatagatttattatgtaaattatagtatatgtaagtagctaatgaagtaaagatcatgaagaaagaaattgataggtgtaaatgagagaccatgtaaaatatgtaaattctagtacctgaaatcctttcaacagatttttatatagcaactgctctctgcaagtagttaaactagaaactgggcacatggtagaggctcacatgggagttgtcctcacccttgttaatctcaagaaactcttatttataataggttgcttctctctcagaacttttatctattacttttttcttcttatgagtatgtttactctcagagtatctatctgatgtagacagttggtgatgcttctgagactcagaatggtttactctaacaaaacactgtgctgtctatcccttgtacttgcctactgtaatatggatttcacttctgaacagtttacagcacaatatttattttaaagtgaataaaatgtccacaagcagtgttgtcatgtagtcaatggca

SEQ ID NO: 9493 - DNA, 1756 bp, Homo sapiens
ggcggcggttgggccggtgatacccgggcgctttatagtcccgccgcctcctcctccacctcctcctcctcctcctctcctcctggagcagaggaggttgtggcggtggctggagaaagcggcggcggaggatggaggaaggaggcggcggcgtacggagtctggtcccgggcgggccggtgttactggtcctctgcggcctcctggaggcgtccggcggcggccgagcccttcctcaactcagcgatgacatccctttccgagtcaactggcccggcaccgagttctctctgcccacaactggagttttatataaagaagataattatgtcatcatgacaactgcacataaagaaaaatataaatgcatacttccccttgtgacaagtggggatgaggaagaagaaaaggattataaaggccctaatccaagagagcttttggagccactatttaaacaaagcagttgttcctacagaattgagtcttattggacttacgaagtatgtcatggaaaacacattcggcagtaccatgaagagaaagaaactggtcagaaaataaatattcacgagtactaccttgggaatatgttggccaagaaccttctatttgaaaaagaacgagaagcagaagaaaaggaaaaatcaaatgagattcccactaaaaatatcgaaggtcagatgacaccatactatcctgtgggaatgggaaatggtacaccttgtagtttgaaacagaaccggcccagatcaagtactgtgatgtacatatgtcatcctgaatctaagcatgaaattctttcagtagctgaagttacaacttgtgaatatgaagttgtcattttgacaccactcttgtgcagtcatcctaaatataggttcagagcatctcctgtgaatgacatattttgtcaatcactgccaggatctccatttaagcccctcaccctgaggcagctggagcagcaggaagaaatactaagggtgccttttaggagaaataaagaggaagatttgcaatcaactaaagaagagagatttccagcgatccacaagtcgattgctattggctctcagccagtgctcactgttgggacaacccacatatccaaattgacagatgaccaactcataaaagagtttcttagtggttcttactgctttcgtgggggtgtcggttggtggaaatatgaattctgctatggcaaacatgtacatcaataccatgaggacaaggatagtgggaaaacctctgtggttgtcgggacatggaaccaagaagagcatattgaatgggctaagaagaatactgctagagcttatcatcttcaagacgatggtacccagacagtcaggtgcaaagaatcagattcacctcatgctgttactgtatatatgctagagcctcactcctgtcaatatattcttggggttgaatctccagtgatctgtaaaatcttagatacagcagatgaaaatggacttctttctctccccaactaaaggatattaaagttaggggaaagaaaagatcattgaaagtcatgataatttctgtcccactgtgtctcattatagagttctcagccattggacctcttctaaaggatggtataaaatgactctcaaccactttgtgaatacatatgtgtatataagaggttattgataaacttctgaggcagacatttgtctcgctttttttcatttttgttgtgtcttataaactgactgtttttctttgcttggatact

SEQ ID NO: 9494 - DNA, 5376 bp, Homo sapiens
aggaggcgctgcggcagcgacggcggcgtcggcggcggccggggctgtcgcgggttggggcggttgggctggcagctgaggctcgtggccatggagtggggttctgagtcggctgctgtgaggcggcaccgcgtcggagtagagcgtcgagagggagcggcggccgcgccaccgccggagagggaggcccgagcgcaggagcctctggtggatgggtgcagcggcggcgggaggacgcggaagaggagccccgggggtagcggcggcgcgagcaggggcgcggggaccgggctgtctgaggtgcgcgccgcgctggggctcgcgctctacctgatcgcgctgcggacgctggtgcagctctcgctgcagcagctcgtgctacgcggggccgctggacaccgcggggagttcgacgcgctccaagccagggattatcttgaacacataacctccattggccccaggactacaggaagtccagaaaatgaaattctgaccgtgcactaccttttggaacagattaaactgattgaagtgcaaagcaacagccttcataagatttcagtagatgtacaacggcccacaggctcttttagcattgatttcttgggaggttttacaagctattatgacaacatcaccaatgttgtggtaaagctggaacccagagatggagcccagcatgctgtcttggctaattgtcattttgactcagtagcaaactcaccaggtgccagtgatgatgcagttagctgctcagtgatgctggaagtccttcgcgtcttgtcaacatcttcagaagccttgcatcatgctgtcatatttctctttaatggtgctgaggaaaatgtcttgcaagccagtcatggtttcattactcagcacccctgggctagcttgattcgtgcattcattaacctagaggcagcaggtgtaggagggaaagaacttgtattccaaacaggtcctgaaaatccttggttggttcaagcttatgtttcagcagctaaacacccttttgcttctgtggtggctcaggaggtttttcagagtggaatcattccttcagatactgactttcgtatctacagggattttgggaacattccaggaatagacttagcttttattgagaatggatacatttatcacaccaagtatgacacagcggacagaattctaacagattccattcagagagcaggtgacaacattttagcagttcttaagcatctagctacatctgatatgctggctgctgcttctaagtatcgacatggaaacatggtcttctttgatgtgctgggcctgtttgtcattgcctacccctctcgtattggctcaatcataaactacatggtggtaatgggtgttgttttgtacctgggcaaaaaatttttgcagcccaaacataagactggtaactacaagaaggacttcttgtgtggacttggcatcactttgatcagctggttcactagccttgttaccgttctcattatagcagtgttcatctctcttattggacagtctctctcatggtataaccacttctatgtctccgtttgtctgtatggaactgcaactgtagccaaaataatacttatacatactcttgcgaaaagattttattacatgaatgccagtgcccagtatctgggagaagtattttttgacatttcgctgtttgtccattgctgttttcttgttaccctcacttaccaaggactttgctcggcgtttattagtgctgtctgggtagcattcccattgctcacaaagctctgtgtgcataaggacttcaagcagcatggtgcccaaggaaaatttattgctttttaccttttggggatgtttattccttatctttatgcattgtacctcatctgggcagtatttgagatgtttacccctatcctcgggagaagtggttctgaaatcccacctgatgttgtgctggcatccattttggctggctgtacaatgattctctcgtcctattttattaacttcatctaccttgccaagagcacaaaaaaaaccatgctaactttaactttggtatgtgcaattacattcctccttgtttgcagtggaacattttttccatatagctccaatcctgctaatccgaagccaaagagagtgtttcttcagcatatgactagaacattccatgacttggaaggaaatgcagttaaacgggactctggaatatggatcaatgggtttgattatactggaatttctcacataacccctcacattcctgagatcaatgatagtatccgagctcactgtgaggagaatgcacctctttgtggttttccttggtatcttccagtgcactttctgatcaggaaaaactggtatcttcctgccccagaagtttctccaagaaatcctcctcatttccgactcatatccaaagaacagacaccttgggattctataaaattgacttttgaagcaacaggaccaagccatatgtccttctatgttcgagcccacaaagggtcaacactttctcagtggtctcttggcaatggcaccccagtcacaagtaaaggaggagactactttgtcttttactcccatggactccaggcctctgcatggcagttctggatagaagtgcaggtttcagaagaacatcctgaaggaatggtcaccgtggccattgctgcccactatctgtctggggaagacaagagatcccctcaactggatgctctgaaggaaaagttcccagattggacatttccctctgcctgggtgtgcacctacgatctctttgtattttaatcttgtggatgagctctaagtacatgcccagtggatactccatgtgacatggtttctccctatgttacgtggatgtttgtaacgtaagtcaatgaattttaatgatcatatgttcaaagagctttctgggttaacgcttttcagggccaagcactataagggtttagctgtggcgcagtgatgcatggcctgttgacacttgaaaatgccagtcttttggcacttcagcacatgtgggtactgccactacacacacgtcattttatatgaccttaaggacaaagccaacaatccacttcaatagctgcccctttaggatcaagaaagatgtacactgtcagagcattgttaatgagacaaaagttgtttccaatttaagccccaaaaccatttgttgtattagtggatggtgggtaaaatatcattcactgaggtaatgattccccttgagaatataactctgtgtaggtcactggaaagtgattgccatagggctgggagagaagcattgcactcttgaggctgtagcctgtgtcaagctgtttcttcaggcagcctctcaaatgtgctttgtctctctgtgctgaggcctggaccctgtgctgagctggtgactcactgtcctgacaagtggacacacagatgcactgctgtgctgctttcctgaggtggttttctatgcctgttttcctctgaaacatgtctgttacccctctccatcttaccaagttgaaaaggggaatatttggccacatacccctctggttttcgtaggttcttttggttcagaatattgtttgtgccagtacatgaccttaacttccttcctcagagcactgagctgccatctgggctattctggggtagaaggaaggctgggagtggtgggaattttataaatatttattctcttttctttgtttcataggagtcttgtgttatacaaggttagtccttcatggtataatcttactgatgcactgggcctatctttttgttttccagccagttgaatagattagtttttctcagtaacttactatccagcagactggctttcctgagacttgaggttgtggcttatactggaatgagaccactgtacgtgtaggtggttcagatcctgcgtaatggcagcatgaggacttaaaaggtggttttcattttgaagatggctatgtagcttgtaaggtgtatcacagcagtacctctcatggctttttggttccagcagtgagggcattggtgagatcaatggtaaactgtgcaagctttctttttatcattaggaaatgtgaaacgttggacaaattttgagttttaacaaggacaaaaagttgaaagaaaaggcacagttaacaaaaaagggtggctagatttatcttgggtgatggaggaaatgagagaggaatgctcttgaaaggtggtctgtggatctgtctgaatagaaagagcacagtaagtatgcattgccggagaaaacgtccttgaagctgcttgtctcatgtgtatgatgtgctttttaaatcatgcccctcgttgcctgcctaatctgtgactccctaaaaactaactgggcccatgtagatggggctgcaaccagagctgaataacatgttaggctcacacatgcatcagcactgcacactggaatcattgctcttcctggactttgtagaaatcagtctcaagtgcttcaagagtctggctcctgctacttttatctgtcaggtagcacataaggtttgcagggtttatattttgtatagaatcacagttgtggagaaaaagtaataatttctcaatgaattttaaaaatgggcctattttctatccccgtggttcatctgatataattagtgttccctgtgaattccccccctctatgggaaggatgcctttactctttatcagtaataaattatgactgttttcatattgccttagggttatttccctgtgtaaaccattgtcttttgttttggttttctttagcattatgaagctttggtattgtacaaggtcagtagtaagatgctcactagtctcagggcttgtgtaatattctgggaggtcatttaaatgccagaaatggtcaagcaattatacacagtatttatgactctgttaagcataccgtttgtctgtcacattagtagattctgagattaaaaaaaatttttaaagagtgatcatttaaataatttctaaaagggtcttttcaagctctaacaaagtcactaacaaatgcattattttctacagaattagatgttagtagtacagtactgcatattcagggaaaaagtgtgaggaattgatttcaaaatagttcgttcttgtgtttgacctaagaatgattgtcgcatgaagtgtttgtttttacagtttagcatatataaacaaacatgataggattccttaagatgttaccacccagggggccacaagccagcctgctgtctcaggaagctgtagaaggagtgtttgtcaatttcttgtcactggtttgctgacttactgaggattaattgttgccttacaatgttactgaaataaactgtttaatat

SEQ ID NO: 9495 - DNA, 2054 bp, Homo sapiens
gatggagcccagcatgctgtcttggctaattgtcattttgactcagtagcaaactcaccaggtgccagtgatgatgcagttagctgctcagtgatgctggaagtccttcgcgtcttgtcaacatcttcagaagccttgcatcatgctgtcatatttctctttaatggtgctgaggaaaatgtcttgcaagccagtcatggtttcattactcagcacccctgggctagcttgattcgtgcattcattaacctagaggcagcaggtgtaggagggaaagaacttgtattccaaacaggtcctgaaaatccttggttggttcaagcttatgtttcagcagctaaacacccttttgcttctgtggtggctcaggaggtttttcagagtggaatcattccttcagatactgactttcgtatctacagggattttgggaacattccaggaatagacttagcttttattgagaatggatacatttatcacaccaagtatgacacagcggacagaattctaacagattccattcagagagcaggtgacaacattttagcagttcttaagcatctagctacatctgatatgctggctgctgcttctaagtatcgacatggaaacatggtcttctttgatgtgctgggcctgtttgtcattgcctacccctctcgtattggctcaatcataaactacatggtggtaatgggtgttgttttgtacctgggcaaaaaatttttgcagcccaaacataagactggtaactacaagaaggacttcttgtgtggacttggcatcactttgatcagctggttcactagccttgttaccgttctcattatagcagtgttcatctctcttattggacagtctctctcatggtataaccacttctatgtctccgtttgtctgtatggaactgcaactgtagccaaaataatacttatacatactcttgcgaaaagattttattacatgaatgccagtgcccagtatctgggagaagtattttttgacatttcgctgtttgtccattgctgttttcttgttaccctcacttaccaaggactttgctcggcgtttattagtgctgtctgggtagcattcccattgctcacaaagctctgtgtgcataaggacttcaagcagcatgattaacttcatctaccttgccaagagcacaaaaaaaaccatgctaactttaactttggtatgtgcaattacattcctccttgtttgcagtggaacattttttccatatagctccaatcctgctaatccgaagccaaagagagtgtttcttcagcatatgactagaacattccatgacttggaaggaaatgcagttaaacgggactctggaatatggatcaatgggtttgattatactggaatttctcacataacccctcacattcctgagatcaatgatagtatccgagctcactgtgaggagaatgcacctctttgtggttttccttggtatcttccagtgcactttctgatcaggaaaaactggtatcttcctgccccagaagtttctccaagaaatcctcctcatttccgactcatatccaaagaacagacaccttgggattctataaaattgacttttgaagcaacaggaccaagccatatgtccttctatgttcgagcccacaaagggtcaacactttctcagtggtctcttggcaatggcaccccagtcacaagtaaaggaggagactactttgtcttttactcccatggactccaggcctctgcatggcagttctggatagaagtgcaggtttcagaagaacatcctgaaggaatggtcaccgtggccattgctgcccactatctgtctggggaagacaagagatcccctcaactggatgctctgaaggaaaagttcccagattggacatttccctctgcctgggtgtgcacctacgatctctttgtattttaatcttgtggatgagctctaagtacatgcccagtggatactccatgtgacatggtttctccctatgttacgtggatgtttgtaacgtaagtcaatgaattttaatgatcat

SEQ ID NO: 9496 - DNA, 3554 bp, Homo sapiens
tcgcgggttggggcggttgggctggcagctgaggctcgtggccatggagtggggttctgagtcggctgctgtgaggcggcaccgcgtcggagtagagcgtcgagagggagcggcggccgcgccaccgccggagagggaggcccgagcgcaggagcctctggtggatgggtgcagcggcggcgggaggacgcggaagaggagccccgggggtagcggcggcgcgagcaggggcgcggggaccgggctgtctgaggtgcgcgccgcgctggggctcgcgctctacctgatcgcgctgcggacgctggtgcagctctcgctgcagcagctcgtgctacgcggggccgctggacaccgcggggagttcgacgcgctccaagccagggattatcttgaacacataacctccattggccccaggactacaggaagtccagaaaatgaaattctgaccgtgcactaccttttggaacagattaaactgattgaagtgcaaagcaacagccttcataagatttcagtagatgtacaacggcccacaggctcttttagcattgatttcttgggaggttttacaagctattatgacaacatcaccaatgttgtggtaaagctggaacccagagatggagcccagcatgctgtcttggctaattgtcattttgactcagtagcaaactcaccaggtgccagtgatgatgcagttagctgctcagtgatgctggaagtccttcgcgtcttgtcaacatcttcagaagccttgcatcatgctgtcatatttctctttaatggtgctgaggaaaatgtcttgcaagccagtcatggtttcattactcagcacccctgggctagcttgattcgtgcattcattaacctagaggcagcaggtgtaggagggaaagaacttgtattccaaacaggtcctgaaaatccttggttggttcaagcttatgtttcagcagctaaacacccttttgcttctgtggtggctcaggaggtttttcagagtggaatcattccttcagatactgactttcgtatctacagggattttgggaacattccaggaatagacttagcttttattgagaatggatacatttatcacaccaagtatgacacagcggacagaattctaacagattccattcagagagcaggtgacaacattttagcagttcttaagcatctagctacatctgatatgctggctgctgcttctaagtatcgacatggaaacatggtcttctttgatgtgctgggcctgtttgtcattgcctacccctctcgtattggctcaatcataaactacatggtggtaatgggtgttgttttgtacctgggcaaaaaatttttgcagcccaaacataagactggtaactacaagaaggacttcttgtgtggacttggcatcactttgatcagctggttcactagccttgttaccgttctcattatagcagtgttcatctctcttattggacagtctctctcatggtataaccacttctatgtctccgtttgtctgtatggaactgcaactgtagccaaaataatacttatacatactcttgcgaaaagattttattacatgaatgccagtgcccagtatctgggagaagtattttttgacatttcgctgtttgtccattgctgttttcttgttaccctcacttaccaaggactttgctcggcgtttattagtgctgtctgggtagcattcccattgctcacaaagctctgtgtgcataaggacttcaagcagcatggtgcccaaggaaaatttattgctttttaccttttggggatgtttattccttatctttatgcattgtacctcatctgggcagtatttgagatgtttacccctatcctcgggagaagtggttctgaaatcccacctgatgttgtgctggcatccattttggctggctgtacaatgattctctcgtcctattttattaacttcatctaccttgccaagagcacaaaaaaaaccatgctaactttaactttggtatgtgcaattacattcctccttgtttgcagtggaacattttttccatatagctccaatcctgctaatccgaagccaaagagagtgtttcttcagcatatgactagaacattccatgacttggaaggaaatgcagttaaacgggactctggaatatggatcaatgggtttgattatactggaatttctcacataacccctcacattcctgagatcaatgatagtatccgagctcactgtgaggagaatgcacctctttgtggttttccttggtatcttccagtgcactttctgatcaggaaaaactggtatcttcctgccccagaagtttctccaagaaatcctcctcatttccgactcatatccaaagaacagacaccttgggattctataaaattgacttttgaagcaacaggaccaagccatatgtccttctatgttcgagcccacaaagggtcaacactttctcagtggtctcttggcaatggcaccccagtcacaagtaaaggaggagactactttgtcttttactcccatggactccaggcctctgcatggcagttctggatagaagtgcaggtttcagaagaacatcctgaaggaatggtcaccgtggccattgctgcccactatctgtctggggaagacaagagatcccctcaactggatgctctgaaggaaaagttcccagattggacatttccctctgcctgggtgtgcacctacgatctctttgtattttaatcttgtggatgagctctaagtacatgcccagtggatactccatgtgacatggtttctccctatgttacgtggatgtttgtaacagggaccagatggcatacttagtgttttctgtaaactgaatttactggcaggaacattttcagctgactgggataaactgatgcttcgattcctgaagaactcaaatccaccacttgaactgggttcctaggattacacaccatatgcagtaccattagagaaagatgctacgtgggtgtatggcctagagaagatgtgtaacttttgcaactaacctgagctgtgggtgtggatggaggtgtctcagattctccagagccaatggctttaagaaatcgaatcatgtgtcgacaaaggtcccacttgccttgttctagtgctgtgttgaatagaagggtagcatgttgcctacttactgcagggacttccatattctacaaaaaacaaccaggacagcattctttttatactacacaatttgggaagatatgagcaattctttatctcgttttctaaactcaaagaatgtagccacaccaccacaggggttagtttaataataagattaaaaagtaccatacaaggaaaagcgaggcaagtactcttctggtgtatgtaaactataatttattaaactcctactacatgccagatagcatacatatactttaagtcatttcatttatttctcccagtgactctgcagataggcatatcatttgtattttacaagtgaggaaactgagttaagtaaattgttgaagatcagcag

SEQ ID NO: 9497 - DNA, 1637 bp, Homo sapiens
cgtattggctcaatcataaactacatggtggtaatgggtgttgttttgtacctgggcaaaaaatttttgcagcccaaacataagactggtaactacaagaaggacttcttgtgtggacttggcatcactttgatcagctggttcactagccttgttaccgttctcattatagcagtgttcatctctcttattggacagtctctctcatggtataaccacttctatgtctccgtttgtctgtatggaactgcaactgtagccaaaataatacttatacatactcttgcgaaaagattttattacatgaatgccagtgcccagtatctgggagaagtattttttgacatttcgctgtttgtccattgctgttttcttgttaccctcacttaccaaggactttgctcggcgtttattagtgctgtctgggtagcattcccattgctcacaaagctctgtgtgcataaggacttcaagcagcatggtgcccaaggaaaatttattgctttttaccttttggggatgtttattccttatctttatgcattgtacctcatctgggcagtatttgagatgtttacccctatcctcgggagaagtggttctgaaatcccacctgatgttgtgctggcatccattttggctggctgtacaatgattctctcgtcctattttattaacttcatctaccttgccaagagcacaaaaaaaaccatgctaactttaactttggtatgtgcaattacattcctccttgtttgcagtggaacattttttccatatagctccaatcctgctaatccgaagccaaagagagtgtttcttcagcatatgactagaacattccatgacttggaaggaaatgcagttaaacgggactctggaatatggatcaatgggtttgattatactggaatttctcacataacccctcacattcctgagatcaatgatagtatccgagctcactgtgaggagaatgcacctctttgtggttttccttggtatcttccagtgcactttctgatcaggaaaaactggtatcttcctgccccagaagtttctccaagaaatcctcctcatttccgactcatatccaaagaacagacaccttgggattctataaaattgacttttgaagcaacagcctgcctgcctatccttcagattttggacttgccagcctcaacaatcatgaccaagccatatgtccttctatgttcgagcccacaaagggtcaacactttctcagtggtctcttggcaatggcaccccagtcacaagtaaaggaggagactactttgtcttttactcccatggactccaggcctctgcatggcagttctggatagaagtgcaggtttcagaagaacatcctgaaggaatggtcaccgtggccattgctgcccactatctgtctggggaagacaagagatcccctcaactggatgctctgaaggaaaagttcccagattggacatttccctctgcctgggtgtgcacctacgatctctttgtattttaatcttgtggatgagctctaagtacatgcccagtggatactccatgtgacatggtttctccctatgttacgtggatgtttgtaacgtaagtcaatgaattttaatgatcatatgttc

SEQ ID NO: 9498 - DNA, 1735 bp, Homo sapiens
cgtggccccaccctctcaccctagacagatgggagcctcctggggtgtccacgtgagcgcgcgtgagtccgcccccccagtcacgtgaccgctgactcggggcgttctccactatcgcttacctacctccctctgcaggaacccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaaggtcattcccaaaagcaagttcgtcttggtgaagttcgacacccagtacccctacggtgagaagcaggatgagttcaagcgtcttgctgaaaactcggcttccagcgatgatctcttggtggcagaggtggggatctcagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagtggacctgaagccattcttttttcttttcaaattatactttcgtctatgacctgctttcctctttgaatctaagctggtatagactccactttcccagggtaacaaactatcctcataacactgtggaaactggcatacctttgttattttccagtgatattcagactgacatggattgactgtcaatggtaaagtttgtctattttccagtccttaaaactcaatagcagtattgatgaatatattgaaccaacattgatggaccatggtgtaattattttccatgctttgtgaggtacacatagcaaattcttagttttactgatatattctgtgacttggatttacacagctaaatgatatagtccgatttcaaaattaaaaaatattttccatctaaatcactatcactaaataaatactaacttctagaaagcagaataaagagcacttgtgccaacatt

SEQ ID NO: 9499 - DNA, 1333 bp, Homo sapiens
gagcctcctggggtgtccacgtgagcgcgcgtgagtccgcccccccagtcacgtgaccgctgactcggggcgttctccactatcgcttacctacctccctctgcaggaacccggcgatatggctgccgctgtgccccgcgccgcatttctctccccgctgcttccccttctcctgggcttcctgctcctctccgctccgcatggcggcagcggcctgcacaccaagggcgcccttcccctggatacggtcactttctacaagattatggtgacaagctgaacatggagctgagtgagaaatacaagctggacaaagagagctacccagtcttctacctcttccgggatggggactttgagaacccagtcccatacactggggcagttaaggttggagccatccagcgctggctgaaggggcaaggggtctacctaggtatgcctggttgcctgcctgtatacgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagtggacctgaagccattcttttttcttttcaaattatactttcgtctatgacctgctttcctctttgaatctaagctggtatagactccactttcccagggtaacaaactatcctcataacactgtggaaactggcatacctttgttattttccagtgatattcagactgacatggattgactgtcaatggtaaagtttgtctattttccagtccttaaaactcaatagcagtat

SEQ ID NO: 9500 - DNA, 3616 bp, Homo sapiens
gcttgtacctgctgtgcagtgaggactccaggaactgatgatgaaccggcacggtcctcggcacgtggcaagttctccataagtgggctcagtaaaatccctctcccgggaaagcgccccaccgtgtttggtggggtgactgggacgcgaggatgcggctgggagtgtgatgagaagggcggggatcggcgaggactccaggctggggttgcaggcccagccaggggcggagccttctccgggtcgggcggggacagagcgctcccttggaggcacccagggacctggccagccgtgcagctgcccaggcgctatggcgagtgcggtcagggggtcgaggccgtggccccggctggggctccagctccagttcgcggcgctgctgctcgggacgctgagtccacaggttcatactctcaggccagagaacctcctgctggtgtccaccttggatggaagtctccacgcactaagcaagcagacaggggacctgaagtggactctgagggatgatcccgtcatcgaaggaccaatgtacgtcacagaaatggcctttctctctgacccagcagatggcagcctgtacatcttggggacccaaaaacaacagggattaatgaaactgccattcaccatccctgagctggttcatgcctctccctgccgcagctctgatggggtcttctacacaggccggaagcaggatgcctggtttgtggtggaccctgagtcaggggagacccagatgacactgaccacagagggtccctccaccccccgcctctacattggccgaacacagtatacggtcaccatgcatgacccaagagccccagccctgcgctggaacaccacctaccgccgctactcagcgccccccatggatggctcacctgggaaatacatgagccacctggcgtcctgcgggatgggcctgctgctcactgtggacccaggaagcgggacggtgctgtggacacaggacctgggcgtgcctgtgatgggcgtctacacctggcaccaggacggcctgcgccagctgccgcatctcacgctggctcgagacactctgcatttcctcgccctccgctggggccacatccgactgcctgcctcaggcccccgggacacagccaccctcttctctaccttggacacccagctgctaatgacgctgtatgtggggaaggatgaaactggcttctatgtctctaaagcactggtccacacaggagtggccctggtgcctcgtggactgaccctggcccccgcagatggccccaccacagatgaggtgacactccaagtctcaggagagcgagagggctcacccagcactgctgttagatacccctcaggcagtgtggccctcccaagccagtggctgctcattggacaccacgagctacccccagtcctgcacaccaccatgctgagggtccatcccaccctggggagtggaactgcagagacaagacctccagagaatacccaggccccagccttcttcttggagctattgagcctgagccgagagaaactttgggactccgagctgcatccagaagaaaaaactccagactcttacttggggctgggaccccaagacctgctggcagctagcctcactgctgtcctcctgggagggtggattctctttgtgatgaggcagcaacagccgcaggtggtggagaagcagcaggagacccccctggcacctgcagactttgctcacatctcccaggatgcccagtccctgcactcgggggccagccggaggagccagaagaggcttcagagtccctcaaagcaagcccagccactcgacgaccctgaagctgagcaactcaccgtagtggggaagatttccttcaatcccaaggacgtgctgggccgcggggcaggcgggactttcgttttccggggacagtttgagggacgggcagtggctgtcaagcggctcctccgcgagtgctttggcctggttcggcgggaagttcaactgctgcaggagtctgacaggcaccccaacgtgctccgctacttctgcaccgagcggggaccccagttccactacattgccctggagctctgccgggcctccttgcaggagtacgtagaaaacccggacctggatcgcgggggtctggagcccgaggtcgtgctgcagcagctgatgtctggcctggcccacctgcactctttacacatagtgcaccgggacctgaagccaggaaatattctcatcaccgggcctgacagccagggcctgggcagagtggtgctctcagacttcggcctctgcaagaagctgcctgctggccgctgtagcttcagcctccactccggcatccccggcacggaaggctggatggcgcccgagcttctgcagctcctgccaccagacagtcctaccagcgctgtggacatcttctctgcaggctgcgtgttctactacgtgctttctggtggcagccacccctttggagacagtctttatcgccaggcaaacatcctcacaggggctccctgtctggctcacctggaggaagaggtccacgacaaggtggttgcccgggacctggttggagccatgttgagcccactgccgcagccacgcccctctgccccccaggtgctggcccaccccttcttttggagcagagccaagcaactccagttcttccaggacgtcagtgactggctggagaaggagtccgagcaggagcccctggtgagggcactggaggcgggaggctgcgcagtggtccgggacaactggcacgagcacatctccatgccgctgcagacagatctgagaaagttccggtcctataaggggacatcagtgcgagacctgctccgtgctgtgaggaacaagaagcaccactacagggagctcccagttgaggtgcgacaggcactcggccaagtccctgatggcttcgtccagtacttcacaaaccgcttcccacggctgctcctccacacgcaccgagccatgaggagctgcgcctctgagagcctcttcctgccctactacccgccagactcagaggccaggaggccatgccctggggccacagggaggtgaggtgggctggatgccacacagatggtctccgtgctggctcactgaagagctgagcctgtggctggcctcagaatcaggctgggtgcagtggctcacacctgtaatcccagcattttgggaggctgagtgagaggatcacttgagctcaggagttcgagaccagcctggccaacatggcaacaccccatttctacaaaaaatttgtaaaattagccaggcatggtggcgcacgcctgtagtcccagctgcttgggaggctgaggtgggagaatcacttgagcccaggagttcgaggctgcagtgagccaggatcatgccactgcactccagcctggtccacagagagacactgtcaccccctttcccccacaagactggcagaggctgggcagcctggggctgatgaagcagagatgttcgctggatcccaggccctggcacccctcaggaaatacaagaaaaagaatattcacatctgtttaatgtgcataaagccaaggaaaggacagttccgaattcaat

SEQ ID NO: 9501 - DNA, 3169 bp, Homo sapiens
acccagggacctggccagccgtgcagctgcccaggcgctatggcgagtgcggtcagggggtcgaggccgtggccccggctggggctccagctccagttcgcggcgctgctgctcgggacgctgagtccacaggttcatactctcaggccagagaacctcctgctggtgtccaccttggatggaagtctccacgcactaagcaagcagacaggggacctgaagtggactctgagggatgatcccgtcatcgaaggaccaatgtacgtcacagaaatggcctttctctctgacccagcagatggcagcctgtacatcttggggacccaaaaacaacagggattaatgaaactgccattcaccatccctgagctggttcatgcctctccctgccgcagctctgatggggtcttctacacaggccggaagcaggatgcctggtttgtggtggaccctgagtcaggggagacccagatgacactgaccacagagggtccctccaccccccgcctctacattggccgaacacagtatacggtcaccatgcatgacccaagagccccagccctgcgctggaacaccacctaccgccgctactcagcgccccccatggatggctcacctgggaaatacatgagccacctggcgtcctgcgggatgggcctgctgctcactgtggacccaggaagcgggacggtgctgtggacacaggacctgggcgtgcctgtgatgggcgtctacacctggcaccaggacggcctgcgccagctgccgcatctcacgctggctcgagacactctgcatttcctcgccctccgctggggccacatccgactgcctgcctcaggcccccgggacacagccaccctcttctctaccttggacacccagctgctaatgacgctgtatgtggggaaggatgaaactggcttctatgtctctaaagcactggtccacacaggagtggccctggtgcctcgtggactgaccctggcccccgcagatggccccaccacagatgaggtgacactccaagtctcaggagagcgagagggctcacccagcactgctgttagatacccctcaggcagtgtggccctcccaagccagtggctgctcattggacaccacgagctacccccagtcctgcacaccaccatgctgagggtccatcccaccctggggagtggaactgcagagacaagacctccagagaatacccaggccccagccttcttcttggagcaacagccgcaggtggtggagaagcagcaggagacccccctggcacctgcagactttgctcacatctcccaggatgcccagtccctgcactcgggggccagccggaggagccagaagaggcttcagagtccctcaaagcaagcccagccactcgacgaccctgaagctgagcaactcaccgtagtggggaagatttccttcaatcccaaggacgtgctgggccgcggggcaggcgggactttcgttttccggggacagtttgagggacgggcagtggctgtcaagcggctcctccgcgagtgctttggcctggttcggcgggaagttcaactgctgcaggagtctgacaggcaccccaacgtgctccgctacttctgcaccgagcggggaccccagttccactacattgccctggagctctgccgggcctccttgcaggagtacgtagaaaacccggacctggatcgcgggggtctggagcccgaggtcgtgctgcagcagctgatgtctggcctggcccacctgcactctttacacatagtgcaccgggacctgaagccaggaaatattctcatcaccgggcctgacagccagggcctgggcagagtggtgctctcagacttcggcctctgcaagaagctgcctgctggccgctgtagcttcagcctccactccggcatccccggcacggaaggctggatggcgcccgagcttctgcagctcctgccaccagacagtcctaccagcgctgtggacatcttctctgcaggctgcgtgttctactacgtgctttctggtggcagccacccctttggagacagtctttatcgccaggcaaacatcctcacaggggctccctgtctggctcacctggaggaagaggtccacgacaaggtggttgcccgggacctggttggagccatgttgagcccactgccgcagccacgcccctctgccccccaggtgctggcccaccccttcttttggagcagagccaagcaactccagttcttccaggacgtcagtgactggctggagaaggagtccgagcaggagcccctggtgagggcactggaggcgggaggctgcgcagtggtccgggacaactggcacgagcacatctccatgccgctgcagacagatctgagaaagttccggtcctataaggggacatcagtgcgagacctgctccgtgctgtgaggaacaagaagcaccactacagggagctcccagttgaggtgcgacaggcactcggccaagtccctgatggcttcgtccagtacttcacaaaccgcttcccacggctgctcctccacacgcaccgagccatgaggagctgcgcctctgagagcctcttcctgccctactacccgccagactcagaggccaggaggccatgccctggggccacagggaggtgaggtgggctggatgccacacagatggtctccgtgctggctcactgaagagctgagcctgtggctggcctcagaatcaggctgggtgcagtggctcacacctgtaatcccagcattttgggaggctgagtgagaggatcacttgagctcaggagttcgagaccagcctggccaacatggcaacaccccatttctacaaaaaatttgtaaaattagccaggcatggtggcgcacgcctgtagtcccagctgcttgggaggctgaggtgggagaatcacttgagcccaggagttcgaggctgcagtgagccaggatcatgccactgcactccagcctggtccacagagagacactgtcaccccctttcccccacaagactggcagaggctgggcagcctggggctgatgaagcagagatgttcgctggatcccaggccctggcacccctcaggaaatacaagaaaaagaatattcacatctgtttaatgtgcataaagccaaggaaagg

SEQ ID NO: 9502 - DNA, 2479 bp, Homo sapiens
agtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgta

SEQ ID NO: 9503 - DNA, 633 bp, Homo sapiens
gtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaaggggattataaatcattacattggagtgtgcttctctgtgcggatgaaatgcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggtggccaagttgaatgatgctgcccggggctctgccagatcctgagacgcttcccctccctgccccacccgggtcctgtgctggctcctgccccttcctgcttttgcagccaggggtcaggaggtggctc

SEQ ID NO: 9504 - DNA, 2546 bp, Homo sapiens
agtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaaggggtatggggcatagtctcttaccctctttctttggagctaaaggaggttcttcgaatgaagtctgtagagcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttg

SEQ ID NO: 9505 - DNA, 792 bp, Homo sapiens
ggcgggtggttggaaagacggtgaatggaaaggggatggctggtggtcttgggtgtgatgtgtgttattggtttgtagaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcct

SEQ ID NO: 9506 - DNA, 725 bp, Homo sapiens
gaaagacggtgaatggaaaggggatggctggtggtcttgggtgtgatgtgtgttattggtttgtagaggacacgcaggagaaagaaggtattctgcctgagagagctgaagaggcaaagctaaaggccaaatacccaagcctaggacaaaagcctggaggctccgacttcctcatgaagagactccagaaaggggattataaatcattacattggagtgtgcttctctgtgcggatgaaatgcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggagg

SEQ ID NO: 9507 - DNA, 703 bp, Homo sapiens
agtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaaggggtatggggcatagtctcttaccctctttctttggagctaaaggaggttcttcgaatgaagtctgtagaggttctactggatccttttctggaggttttgttgttgaacagaagtagaggcgaatttgaaatttgaaaagagcaagtcaaattaatgtaaatccctgatgtggtatcaattccctcctgatttcccatgtaggaaattaaggcctaaattggagcatttgggtgtgtggggaaatgagggaaagatgttagaaactgaaatgcagactgcccccaggcatttgcctgtttgaatgttggaggttttaggattgtgcactttttaagcattagagataaattttgggatgcatcatttcagaagaagatcaaaccatctctcctacagaaataaatcctcaactt

SEQ ID NO: 9508 - DNA, 1277 bp, Homo sapiens
attttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaaggggtatggggcatagtctcttaccctctttctttggagctaaaggaggttcttcgaatgaagtctgtagagcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccag

SEQ ID NO: 9509 - DNA, 2085 bp, Homo sapiens
attttgactgagcaaccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcgggtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaatattctgaagcagttggtgtgttttattggggtttgggagggggaagaaaacaatactgaagacattgttaatgtgagatgcggctgagttccccaataccatcacttaggaaagggagcaggaatgttggcataaaccttgcccatccctttgtttctgtaaccaatgtagaaggtgcatcaacctcagtttgtggctcacaaaatgaggcatttaagatatttgatctaaatggtttcttgacacctaagcctagtccaggtttagcagaaaaggaggcccagtctccttttccctctgtcttccattccttttcaagttcccatgtttgtgagggagaaatgtgacaaaccaaaagaaatatattatttctttgtaataagccaaaagaaactcaagtctttctgctggtggccagcaggaggcagagtgatttctttcctcatgatgtgccaatctgcattgctggaaacctgctactgaaagaagttaaaagctgcctgtgaatgtaacgtacaaaagaaaggttaccaaaggagaaaaaactccagcgggtgtacggtggctcacgcctataattccagcactttgggaggccaaggtgggtggatcacttgaggtcaggagtttgagaccagcctagccaacatggtgaaaccccatctctactaaaaatacaaaaattagccgggcgtggcggcacatgcctataatcccacttacttgggaggctgaggtaggagaatcgcttgaacccaggaggcagagtttgcagtgagccgagattgtgccattgcactccagcctgggcgacagagcgagactccatctaaaaaaaataaatgaataaaataaaacaagtacaaatttaaa

SEQ ID NO: 9510 - DNA, 574 bp, Homo sapiens
agcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaaggggattataaatcattacattggagtgtgcttctctgtgcggatgaaatgcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagat

SEQ ID NO: 9511 - DNA, 793 bp, Homo sapiens
ccctagtgacaggagccgaagcagcagcgcaggttgtccccgtttcccctcccccttcccttctccggttgccttcccgggccccttacactccacagtcccggtcccgccatgtcccagaaacaagaagaagagaaccctgcggaggagaccggcgaggagaagcaggacacgcaggagaaagaaggtattctgcctgagagagctgaagaggcaaagctaaaggccaaatacccaagcctaggacaaaagcctggaggctccgacttcctcatgaagagactccagaaaggggtatggggcatagtctcttaccctctttctttggagctaaaggaggttcttcgaatgaagtctgtagaggttctactggatccttttctggaggttttgttgttgaacagaagtagaggcgaatttgaaatttgaaaagagcaagtcaaattaatcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttattt

SEQ ID NO: 9512 - DNA, 1369 bp, Homo sapiens
atggaaaggggatggctggtggtcttgggtgtgatgtgtgttattggtttgtagaggacacgcaggagaaagaaggtattctgcctgagagagctgaagaggcaaagctaaaggccaaatacccaagcctaggacaaaagcctggaggctccgacttcctcatgaagagactccagaaagggcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggc

SEQ ID NO: 9513 - DNA, 1826 bp, Homo sapiens
gggctggagccgccctgggtgtcagcggctcggctcccgcgcacgctccggccgtcgcgcagcctcggcacctgcaggtccgtgcgtcccgcggctggcgcccctgactccgtcccggccagggagggccatgatttccctcccggggcccctggtgaccaacttgctgcggtttttgttcctggggctgagtgccctcgcgcccccctcgcgggcccagctgcaactgcacttgcccgccaaccggttgcaggcggtggagggaggggaagtggtgcttccagcgtggtacaccttgcacggggaggtgtcttcatcccagccatgggaggtgccctttgtgatgtggttcttcaaacagaaagaaaaggaggatcaggtgttgtcctacatcaatggggtcacaacaagcaaacctggagtatccttggtctactccatgccctcccggaacctgtccctgcggctggagggtctccaggagaaagactctggcccctacagctgctccgtgaatgtgcaagacaaacaaggcaaatctaggggccacagcatcaaaaccttagaactcaatgtactggttcctccagctcctccatcctgccgtctccagggtgtgccccatgtgggggcaaacgtgaccctgagctgccagtctccaaggagtaagcccgctgtccaataccagtgggatcggcagcttccatccttccagactttctttgcaccagcattagatgtcatccgtgggtctttaagcctcaccaacctttcgtcttccatggctggagtctatgtctgcaaggcccacaatgaggtgggcactgcccaatgtaatgtgacgctggaagtgagcacagggcctggagctgcagtggttgctggagctgttgtgggtaccctggttggactggggttgctggctgggctggtcctcttgtaccaccgccggggcaaggccctggaggagccagccaatgatatcaaggaggatgccattgctccccggaccctgccctggcccaagagctcagacacaatctccaagaatgggaccctttcctctgtcacctccgcacgagccctccggccaccccatggccctcccaggcctggtgcattgacccccacgcccagtctctccagccaggccctgccctcaccaagactgcccacgacagatggggcccaccctcaaccaatatcccccatccctggtggggtttcttcctctggcttgagccgcatgggtgctgtgcctgtgatggtgcctgcccagagtcaagctggctctctggtatgatgaccccaccactcattggctaaaggatttggggtctctccttcctataagggtcacctctagcacagaggcctgagtcatgggaaagagtcacactcctgacccttagtactctgcccccacctctctttactgtgggaaaaccatctcagtaagacctaagtgtccaggagacagaaggagaagaggaagtggatctggaattgggaggagcctccacccacccctgactcctccttatgaagccagctgctgaaattagctactcaccaagagtgaggggcagagacttccagtcactgagtctcccaggcccccttgatctgtaccccacccctatctaacaccacccttggctcccactccagctccctgtattgatataacctgtcaggctggcttggttaggttttactggggcagaggatagggaatctcttattaaaactaacatgaaatatgtgttgttttcatttgcaaatttaaataaagatacataatgtttgtatgagataagaaacaa

SEQ ID NO: 9514 - DNA, 1013 bp, Homo sapiens
agacttgggctggagccgccctgggtgtcagcggctcggctcccgcgcacgctccggccgtcgcgcagcctcggcacctgcaggtccgtgcgtcccgcggctggcgcccctgactccgtcccggccagggagggccatgatttccctcccggggcccctggtgaccaacttgctgcggtttttgttcctggggctgagtgccctcgatgtcatccgtgggtctttaagcctcaccaacctttcgtcttccatggctggagtctatgtctgcaaggcccacaatgaggtgggcactgcccaatgtaatgtgacgctggaagtgagcacagggcctggagctgcagtggttgctggagctgttgtgggtaccctggttggactggggttgctggctgggctggtcctcttgtaccaccgccggggcaaggccctggaggagccagccaatgatatcaaggtgaggtctcctttaggtctcagtttctctgcccctaaaatggagtggctctggaaatggagagatgctcatttctacagagactcctacctcagtaagtggtgaaatgaaaagcgctgtggacaggaagggtctgcggcctggggctcacactcacagtgaggctccgaggtggggactccccttgccagctctggggtatcaggacgccttccaaagtcagctttccttccgtctctgcagaaggcccaccccaagcccagcgcttttcccaaggccggacagcttcagaccttggggagaagaggaaggaaggaggaagaagggacagagggattgcagaatcggggctggaggagaggagggaggagcacttttttttttttttaacctgcggcgccggcctctcccctgtttgctctgagataccagtctcgctcctgcccagcccgggcggctgcccttgggtgctcccttccctgcccgacacccagaccgaccttgaccgcccacctggcaggagcaggacaggacggccggacgcggccatggccga

SEQ ID NO: 9515 - DNA, 5160 bp, Homo sapiens
gctttacactcgcgagcggaccgccacacgggtccggtgcccgctgcgcttccgccccagcgctcctgaggcggccgtacaatcctcggcagtgtcctgagactgtatggtcagctcagcccggcctccgactccttccgactcccagcattcgagccacttttttttttctttgaaaactcagaaaagtgactccttttccagggaaaaaggaacttgggttcccttctctccgtcctcttttcgggtctgacagcctccacccactccttccccggaccccgcctccgcgcgcaggttcctcccagtcacctttctccacccccgcccccgcacctagcccgccgcgcgccaccttccacctgactgcgcggggcgctcgggacctgcgcgcacctcggaccttcaccacccgcccgggccgcggggagcggacgagggccacagccccccacccgccagggagcccaggtgctcggcgtctgaacgtctcaaagggccacagcgacaatgacagctgacaaggagaagaaaaggagtagctcggagaggaggaaggagaagtcccgggatgctgcgcggtgccggcggagcaaggagacggaggtgttctatgagctggcccatgagctgcctctgccccacagtgtgagctcccatctggacaaggcctccatcatgcgactggcaatcagcttcctgcgaacacacaagctcctctcctcagtttgctctgaaaacgagtccgaagccgaagctgaccagcagatggacaacttgtacctgaaagccttggagggtttcattgccgtggtgacccaagatggcgacatgatctttctgtcagaaaacatcagcaagttcatgggacttacacaggtggagctaacaggacatagtatctttgacttcactcatccctgcgaccatgaggagattcgtgagaacctgagtctcaaaaatggctctggttttgggaaaaaaagcaaagacatgtccacagagcgggacttcttcatgaggatgaagtgcacggtcaccaacagaggccgtactgtcaacctcaagtcagccacctggaaggtcttgcactgcacgggccaggtgaaagtctacaacaactgccctcctcacaatagtctgtgtggctacaaggagcccctgctgtcctgcctcatcatcatgtgtgaaccaatccagcacccatcccacatggacatccccctggatagcaagaccttcctgagccgccacagcatggacatgaagttcacctactgtgatgacagaatcacagaactgattggttaccaccctgaggagctgcttggccgctcagcctatgaattctaccatgcgctagactccgagaacatgaccaagagtcaccagaacttgtgcaccaagggtcaggtagtaagtggccagtaccggatgctcgcaaagcatgggggctacgtgtggctggagacccaggggacggtcatctacaaccctcgcaacctgcagccccagtgcatcatgtgtgtcaactacgtcctgagtgagattgagaagaatgacgtggtgttctccatggaccagactgaatccctgttcaagccccacctgatggccatgaacagcatctttgatagcagtggcaagggggctgtgtctgagaagagtaacttcctattcaccaagctaaaggaggagcccgaggagctggcccagctggctcccaccccaggagacgccatcatctctctggatttcgggaatcagaacttcgaggagtcctcagcctatggcaaggccatcctgcccccgagccagccatgggccacggagttgaggagccacagcacccagagcgaggctgggagcctgcctgccttcaccgtgccccaggcagctgccccgggcagcaccacccccagtgccaccagcagcagcagcagctgctccacgcccaatagccctgaagactattacacatctttggataacgacctgaagattgaagtgattgagaagctcttcgccatggacacagaggccaaggaccaatgcagtacccagacggatttcaatgagctggacttggagacactggcaccctatatccccatggacggggaagacttccagctaagccccatctgccccgaggagcggctcttggcggagaacccacagtccaccccccagcactgcttcagtgccatgacaaacatcttccagccactggcccctgtagccccgcacagtcccttcctcctggacaagtttcagcagcagctggagagcaagaagacagagcccgagcaccggcccatgtcctccatcttctttgatgccggaagcaaagcatccctgccaccgtgctgtggccaggccagcacccctctctcttccatggggggcagatccaatacccagtggcccccagatccaccattacattttgggcccacaaagtgggccgtcggggatcagcgcacagagttcttgggagcagcgccgttggggccccctgtctctccaccccatgtctccaccttcaagacaaggtctgcaaagggttttggggctcgaggcccagacgtgctgagtccggccatggtagccctctccaacaagctgaagctgaagcgacagctggagtatgaagagcaagccttccaggacctgagcgggggggacccacctggtggcagcacctcacatttgatgtggaaacggatgaagaacctcaggggtgggagctgccctttgatgccggacaagccactgagcgcaaatgtacccaatgataagttcacccaaaaccccatgaggggcctgggccatcccctgagacatctgccgctgccacagcctccatctgccatcagtcccggggagaacagcaagagcaggttccccccacagtgctacgccacccagtaccaggactacagcctgtcgtcagcccacaaggtgtcaggcatggcaagccggctgctcgggccctcatttgagtcctacctgctgcccgaactgaccagatatgactgtgaggtgaacgtgcccgtgctgggaagctccacgctcctgcaaggaggggacctcctcagagccctggaccaggccacctgagccaggccttctacctgggcagcacctctgccgacgccgtcccaccagcttcactctctccgtctgtttttgcaactaggtatttctaacgccagcacactatttacaagatggacttacctggcagacttgcccaggtcaccaagcagtggcctttttctgagatgctcactttattatccctatttttaaagtacacaattgttttacctgttctgaaatgttcttaaattttgtaggatttttttcctccccaccttcaatgacttctaatttatattatccataggtttctctccctccttctccttctcacacacaactgtccatactaacaagtttggtgcatgtctgttcttctgtagggagaagctttagcttcattttactaaaaagattcctcgttattgttgttgccaaagagaaacaaaaatgattttgctttccaagcttggtttgtggcgtctccctcgcagagcccttctcgtttcttttttaaactaatcaccatattgtaaatttcagggtttttttttttttgtttaagctgactctttgctctaattttggaaaaaaagaaatgtgaagggtcaactccaacgtatgtggttatctgtgaaagttgcacagcgtggcttttcctaaactggtgtttttcccccgcatttggtggattttttattattattcaaaaacataactgagttttttaaaagaggagaaaatttatatctgggttaagtgtttatcatatatatgggtactttgtaatatctaaaaacttagaaacggaaatggaatcctgctcacaaaatcactttaagatcttttcgaagctgttaatttttcttagtgttgtggacactgcagacttgtccagtgctcccacggcctgtacggacactgtggaaggcctccctctgtcggctttttgccatctgtgatatgccataggtgtgacaatccgagcagtggagtcattcagcgggagcactgcgcgctatcccctcacattctctatgtactatgtatgtatgtattattattattgctgccaagagggtctgatggcacgttgtggggtcggggggtggggcggggaagtgctctaacttttcttaaggttttgttgctagcccttcaagtgcactgagctatgtgactcggatggtctttcacacggcacatttggacatttccagaactaccatgagatggtttagacgggaattcatgcaaatgaggggtcaaaaatggtatagtgaccccgtccacgtcctccaagctcacgaccttggagccccgtggagctggactgaggaggaggctgcacagcgggagagcagctggtccagaccagccctgcagcccccactcagccggcagccagatggccccgcaaggcctccagggatggcccctagccacaggccctggctgaggtctctgggtcggtcagtgacatgtaggtaggaagcactgaaaatagtgttcccagagcactttgcaactccctgggtaagagggacgacacctctggtttttcaataccaattacatggaacttttctgtaatgggtacaatgaagaagtttctaaaaacacacacaaagcacattgggccaactatttagtaagcccggatagacttattgccaaaaacaaaaaatagctttcaaaagaaatttaagttctatgagaaattccttagtcatggtgttgcgtaaatcatattttagctgcacggcattaccccacacagggtggcagaacttgaagggttactgacgtgtaaatgctggtatttgatttcctgtgtgtgttgccctggcattaagggcattttacccttgcagttttactaaaacactgaaaaatattccaagcttcatattaaccctacctgtcaacgtaacgatttcatgaacgttattatattgtcgaattcctactgacaacattataactgtatgggagcttaactttataaggaaatgtattttgacactggtatcttattaaagtattctgatccta

SEQ ID NO: 9516 - DNA, 1067 bp, Homo sapiens
agatcacactggggaaccagactgacttctccaattctgaactcgccccggcctcgggcggctcaaagggcctcctctgccgcatccccgccaaaaccaaaccgcctggcacaagccgcccgccgcgcgccaccttccacctgactgcgcggggcgctcgggacctgcgcgcacctcggaccttcaccacccgcccgggccgcggggagcggacgagggccacagccccccacccgccagggagcccaggtgctcggcgtctgaacgtctcaaagggccacagcgacaatgacagctgacaaggagaagaaaaggagtagctcggagaggaggaaggagaagtcccgggatgctgcgcggtgccggcggagcaaggagacggaggtgttctatgagctggcccatgagctgcctctgccccacagtgtgagctcccatctggacaaggcctccatcatgcgactggcaatcagcttcctgcgaacacacaagctcctctcctcagtttgctctgaaaacgagtccgaagccgaagctgaccagcagatggacaacttgtacctgaaagccttggagggtttcattgccgtggtgacccaagatggcgacatgatctttctgtcagaaaacatcagcaagttcatgggacttacacaggtggagctaacaggacatagtatctttgacttcactcatccctgcgaccatgaggagattcgtgagaacctgagtctcaaaaatggctctggttttgggaaaaaaagcaaagacatgtccacagagcgggacttcttcatgaggatgaagtgcacggtcaccaacagaggccgtactgtcaacctcaagtcagccacctggaaggtcttgcactgcacgggccaggtgaaagtctacaacaactgccctcctcacaatagtctgtgtggctacaaggagcccctgctgtcctgcctcatcatcatgtgtgaaccaatccagcacccatcccacatggacatccccctggatagcaagaccttcctgagccgccacagcatggacatgaagttcacctactgtgatgacag

SEQ ID NO: 9517 - DNA, 1241 bp, Homo sapiens
cagcttaatagcaggacgctggcaacaggcactccctgctccagtccagcctgcgcgctccaccgccgctatggtctccgtgcctaccacctggtgctccgttgcgctagccctgctcgtggccctgcatgaagggaagggccaggctgctgccaccctggagcagccagcgtcctcatctcatgcccaaggcacccaccttcggcttcgccgttgctcctgcagctcctggctcgacaaggagtgcgtctacttctgccacttggacatcatctgggtgaacactcctgaacagacagctccttacggcctgggaaacccgccaagacgccggcgccgctccctgccaaggcgctgtcagtgctccagtgccagggaccccgcctgtgccaccttctgccttcgaaggccctggactgaagccggggcagtcccaagccggaagtcccctgcagacgtgttccagactggcaagacaggggccactacaggagagcttctccaaaggctgagggacatttccacagtcaagagcctctttgccaagcgacaacaggaggccatgcgggagcctcggtccacacattccaggtggaggaagagatagtgtcgtgagctggaggaacattgggaaggaagcccgcggggagagaggaggagagaagtggccagggcttgtggactctctgcctgcttcctggaccggggccttggtcccagacagctggacccatttgccaggattggcacaagctccctggtgagggagcctcgtccaaggcagttctgtgtcctcgcactgcccagggaagccctcggcctccagactgcggagcagcctccagtgctggctgctggcccacagctctgctggaagaactgcatggggagtacattcatctggaggctgcgtcctgaggagtgtcctgtctgctgggctacaaaccaggagcaaccgtgcagccacgaacacgcatgcctcagccagccctggaggctggatggctcccctgaggctggcatcctggctggctgtgtcctctccagctttccctccccagagttcttgcaccctcattccctcgggaccctcccagtgagaagggcctgctctgcttttcctgtctgtatataacttatttgccctaagaactttgagaatcccaattatttattttaatgtattttttagaccctctatttacctgcgaacttgtgtttataataaatgaggaaacata

SEQ ID NO: 9518 - DNA, 2655 bp, Homo sapiens
cctcgggccgctgcgctcctggccagctccccccagcgcctgggaggcgacccccagtgcgcccgggttcaaaggcccggcgaggcagttccagcccctctggggggcggggaggcgacgggggtggtgcagaagccagaaaagcccgagccacagccggccagctccgcgcagggatgggcagcgcgctctgaaagtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttcatggagccggggctgtggctccttttcgggctcacagtgacctccgccgcaggattcgtgccttgctcccagtctggggatgctggcaggcgcggcgtgtcccaggcccccactgcagccagatctgagggggactgtgaagagactgtggctggccctggcgaggagactgtggctggccctggcgaggggactgtggccccgacagcactgcagggtccaagccctggaagccctgggcaggagcaggcggccgagggggcccctgagcaccaccgatccaggcgctgcacgtgcttcacctacaaggacaaggagtgtgtctactattgccacctggacatcatttggatcaacactcccgaacagacggtgccctatggactgtccaactacagaggaagcttccggggcaagaggtctgcggggccacttccagggaatctgcagctctcacatcggccacacttgcgctgcgcttgtgtggggagatatgacaaggcctgcctgcacttttgcacccaaactctggacgtcagcagtaattcaaggacggcagaaaaaacagacaaagaagaggaagggaaggtgagaggtgccaacagaggcctgtgtcaaaggaggttgaagtcaaggaccaacaaagcaagcaggctttagacctccaccatccaaagctcatgcccggcagtggactcgccctcgctccatctacctgcccccgctgcctctttcaggaaggagccccttaggaggacaggcctgcagcatcctggtctcgggaggcttctgtcattgctcacacacagttcagatttccacctctttatagacaagaagtgaatttgcctggggcagaacacccacccaaagagtccccacttaacaataccccccccccacggcaagaatgcccaaatccgaatgaccccagttttcctaatgagtaaaatgatcccagatgtgccccagagcatgacgcctgcagctccggtttcatgcaggaaattggttttggagagttttggcaagttggaaagccacttactggcttttgacatgacttctcttggagaataagtggactccaagctaactctttgcaaatgtaaacacatgtccatcttgtaataaatgcaaaatgcccgtgcagcagaagcatgcgactttcatatccttgcctagaataggctgcatggtgtatgtcagtgagggccacgaggcgtcggctttagacacagatcatagctctacaggagtttatgaatttgaagcttatgggattttggcagagaaattttcagctgtgcttgatacccaccaaaagaatgtatctcgaaagaatgaaggaagaagaaaaaaggatccttgatgtttgtgacaagaaaatgagaaagttagtatctgcaatacagagcttgttcctgttcagtgactgaccctctgtattctgtatagacaccaggccgatacacagtggagttcccaggccttgtttgcaggaagccgactgtaaagacagccccagctcaaggctattaggttgaatatttgctttcatgagtaaatgtggatctttggggaatggcttcaaaataagtcacgaacacaaattctttgtaaattatgtaaattcctgtttatataaattggcaacaacttataccgtctgacagttcaaaatctctttcagctgcgctcttcccaccgagccgagcttactgtgagtgtggagatgttatcccaccatgtaaagtcgcctgcgcaggggagggctgcccatctccccaacccagtcacagagagataggaaacggcatttgagtgggtgtccagggccccgtagagagacatttaagatggtgtatgacagagcattggccttgaccaaatgttaaatcctctgtgtgtatttcataagttattacaggtataaaagtgatgacctatcatgaggaaatgaaagtggctgatttgctggtaggattttgtacagtttagagaagcgattatttattgtgaaactgttctccactccaactcctttatgtggatctgttcaaagtagtcactgtatatacgtatagagaggtagataggtaggtagattttaaattgcattctgaatacaaactcatactccttagagcttgaattacatttttaaaatgcatatgtgctgtttggcaccgtggcaagatggtatcagagagaaacccatcaattgctcaaatactcagaaagtactgtcaaaagcctaataaaaaacctaaagtttgctctga

SEQ ID NO: 9519 - DNA, 2636 bp, Homo sapiens
cgctgtcctgggtgcgcctcgggccgctgcgctcctggccagctccccccagcgcctgggaggcgacccccagtgcgcccgggttcaaaggcccggcgaggcagttccagcccctctggggggcggggaggcgacgggggtggtgcagaagccagaaaagcccgagccacagccggccagctccgcgcagggatgggcagcgcgctctgaaagtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttcatggagccggggctgtggctccttttcgggctcacagtgacctccgccgcaggattcgtgccttgctcccagtctggggatgctggcaggcgcggcgtgtcccaggcccccactgcagccagatctgagggggactgtgaagagactgtggctggccctggcgaggagactgtggctggccctggcgaggggactgtggccccgacagcactgcagggtccaagccctggaagccctgggcaggagcaggcggccgagggggcccctgagcaccaccgatccaggcgctgcacgtgcttcacctacaaggacaaggagtgtgtctactattgccacctggacatcatttggatcaacactcccgaacagacggtgccctatggactgtccaactacagaggaagcttccggggcaagaggtctgcggggccacttccagggaatctgcagctctcacatcggccacacttgcgctgcgcttgtgtggggagatatgacaaggcctgcctgcacttttgcacccaaactctggacgtcagcagtaattcaaggacggcagaaaaaacagacaaagaagaggaagggaaggttgaagtcaaggaccaacaaagcaagcaggctttagacctccaccatccaaagctcatgcccggcagtggactcgccctcgctccatctacctgcccccgctgcctctttcaggaaggagccccttaggaggacaggcctgcagcatcctggtctcgggaggcttctgtcattgctcacacacagttcagatttccacctctttatagacaagaagtgaatttgcctggggcagaacacccacccaaagagtccccacttaacaataccccccccccacggcaagaatgcccaaatccgaatgaccccagttttcctaatgagtaaaatgatcccagatgtgccccagagcatgacgcctgcagctccggtttcatgcaggaaattggttttggagagttttggcaagttggaaagccacttactggcttttgacatgacttctcttggagaataagtggactccaagctaactctttgcaaatgtaaacacatgtccatcttgtaataaatgcaaaatgcccgtgcagcagaagcatgcgactttcatatccttgcctagaataggctgcatggtgtatgtcagtgagggccacgaggcgtcggctttagacacagatcatagctctacaggagtttatgaatttgaagcttatgggattttggcagagaaattttcagctgtgcttgatacccaccaaaagaatgtatctcgaaagaatgaaggaagaagaaaaaaggatccttgatgtttgtgacaagaaaatgagaaagttagtatctgcaatacagagcttgttcctgttcagtgactgaccctctgtattctgtatagacaccaggccgatacacagtggagttcccaggccttgtttgcaggaagccgactgtaaagacagccccagctcaaggctattaggttgaatatttgctttcatgagtaaatgtggatctttggggaatggcttcaaaataagtcacgaacacaaattctttgtaaattatgtaaattcctgtttatataaattggcaacaacttataccgtctgacagttcaaaatctctttcagctgcgctcttcccaccgagccgagcttactgtgagtgtggagatgttatcccaccatgtaaagtcgcctgcgcaggggagggctgcccatctccccaacccagtcacagagagataggaaacggcatttgagtgggtgtccagggccccgtagagagacatttaagatggtgtatgacagagcattggccttgaccaaatgttaaatcctctgtgtgtatttcataagttattacaggtataaaagtgatgacctatcatgaggaaatgaaagtggctgatttgctggtaggattttgtacagtttagagaagcgattatttattgtgaaactgttctccactccaactcctttatgtggatctgttcaaagtagtcactgtatatacgtatagagaggtagataggtaggtagattttaaattgcattctgaatacaaactcatactccttagagcttgaattacatttttaaaatgcatatgtgctgtttggcaccgtggcaagatggtatcagagagaaacccatcaattgctcaaatactcagaaagtactgtcaaaagcctaataaaaaacctaaagtttgctctga

SEQ ID NO: 9520 - DNA, 1153 bp, Homo sapiens
gatgggcagcgcgctctgaaagtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttcatggagccggggctgtggctccttttcgggctcacagtgacctccgccgcaggattcgtgccttgctcccagtctggggatgctggcaggcgcggcgtgtcccaggcccccactgcagccagatctgagggggactgtgaagagactgtggctggccctggcgaggagactgtggctggccctggcgaggggactgtggccccgacagcactgcagggtccaagccctggaagccctgggcaggagcaggcggccgagggggcccctgagcaccaccgatccaggcgctgcacgtgcttcacctacaaggacaaggagtgtgtctactattgccacctggacatcatttggatcaacactcccgaacagacggtgccctatggactgtccaactacagaggaagcttccggggcaagaggtctgcggggccacttccagggaatctgcagctctcacatcggccacacttgcgctgcgcttgtgtggggagatatgacaaggcctgcctgcacttttgcacccaaactctggacgtcagcaggttgaagtcaaggaccaacaaagcaagcaggctttagacctccaccatccaaagctcatgcccggcagtggactcgccctcgctccatctacctgcccccgctgcctctttcaggaaggagccccttaggaggacaggcctgcagcatcctggtctcgggaggcttctgtcattgctcacacacagttcagatttccacctctttatagacaagaagtgaatttgcctggggcagaacacccacccaaagagtccccacttaacaataccccccccccacggcaagaatgcccaaatccgaatgaccccagttttcctaatgagtaaaatgatcccagatgtgccccagagcatgacgcctgcagctccggtttcatgcaggaaattggttttggagagttttggcaagttggaaa

SEQ ID NO: 9521 - DNA, 2397 bp, Homo sapiens
ctcgggccgctgcgctcctggccagctccccccagcgcctgggaggcgacccccagtgcgcccgggttcaaaggcccggcgaggcagttccagcccctctggggggcggggaggcgacgggggtggtgcagaagccagaaaagcccgagccacagccggccagctccgcgcagggatgggcagcgcgctctgaaagtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttcatggagccggggctgtggctccttttcgggctcacagtgacctccgccgcaggattcgtgccttgctcccagtctggggatgctggcaggcgcggcgtgtcccaggcccccactgcagccagatctgagggggactgtgaagagactgtggctggccctggcgaggagactgtggctggccctggcgaggggactgtggccccgacagcactgcagggtccaagccctggaagccctgggcaggagcaggcggccgagggggcccctgagcaccaccgatccaggcgctgcacgtgcttcacctacaaggacaaggagtgtgtctactattgccacctggacatcatttggatcaacactcccgaacagacggtgccctatggactgtccaactacagaggaagcttccggggcaagaggtctgcggggccacttccagggaatctgcagctctcacatcggccacacttgcgctgcgcttgtgtggggagatatgacaaggcctgcctgcacttttgcacccaaactctggacgtcagcagtaattcaaggacggcagaaaaaacagacaaagaagaggaagggaaggttgaagtcaaggaccaacaaagcaagcaggctttagacctccaccatccaaagctcatgcccggcagtggactcgccctcgctccatctacctgcccccgctgcctctttcaggaaggagccccttaggaggacaggcctgcactccggtttcatgcaggaaattggttttggagagttttggcaagttggaaagccacttactggcttttgacatgacttctcttggagaataagtggactccaagctaactctttgcaaatgtaaacacatgtccatcttgtaataaatgcaaaatgcccgtgcagcagaagcatgcgactttcatatccttgcctagaataggctgcatggtgtatgtcagtgagggccacgaggcgtcggctttagacacagatcatagctctacaggagtttatgaatttgaagcttatgggattttggcagagaaattttcagctgtgcttgatacccaccaaaagaatgtatctcgaaagaatgaaggaagaagaaaaaaggatccttgatgtttgtgacaagaaaatgagaaagttagtatctgcaatacagagcttgttcctgttcagtgactgaccctctgtattctgtatagacaccaggccgatacacagtggagttcccaggccttgtttgcaggaagccgactgtaaagacagccccagctcaaggctattaggttgaatatttgctttcatgagtaaatgtggatctttggggaatggcttcaaaataagtcacgaacacaaattctttgtaaattatgtaaattcctgtttatataaattggcaacaacttataccgtctgacagttcaaaatctctttcagctgcgctcttcccaccgagccgagcttactgtgagtgtggagatgttatcccaccatgtaaagtcgcctgcgcaggggagggctgcccatctccccaacccagtcacagagagataggaaacggcatttgagtgggtgtccagggccccgtagagagacatttaagatggtgtatgacagagcattggccttgaccaaatgttaaatcctctgtgtgtatttcataagttattacaggtataaaagtgatgacctatcatgaggaaatgaaagtggctgatttgctggtaggattttgtacagtttagagaagcgattatttattgtgaaactgttctccactccaactcctttatgtggatctgttcaaagtagtcactgtatatacgtatagagaggtagataggtaggtagattttaaattgcattctgaatacaaactcatactccttagagcttgaattacatttttaaaatgcatatgtgctgtttggcaccgtggcaagatggtatcagagagaaacccatcaattgctcaaatactcagaaagtactgtcaaaagcctaataaaaaacctaaagtttgctctg

SEQ ID NO: 9522 - DNA, 2318 bp, Homo sapiens
cgaacccccacagctggagggcgaggccagctgtacccggccccagtgccctttcgcggccacaagcggccgtcctcctggtccggtgctccggcgcctgatctaggttcatggagccggggctgtggctccttttcgggctcacagtgacctccgccgcaggattcgtgccttgctcccagtctggggatgctggcaggcgcggcgtgtcccaggcccccactgcagccagatctgagggggactgtgaagagactgtggctggccctggcgaggagactgtggctggccctggcgaggggactgtggccccgacagcactgcagggtccaagccctggaagccctgggcaggagcaggcggccgagggggcccctgagcaccaccgatccaggcgctgcacgtgcttcacctacaaggacaaggagtgtgtctactattgccacctggacatcatttggatcaacactcccgaacagacggtgccctatggactgtccaactacagaggaagcttccggggcaagaggtctgcggggccacttccagggaatctgcagctctcacatcggccacacttgcgctgcgcttgtgtggggagatatgacaaggcctgcctgcacttttgcacccaaactctggacgtcagcagacaggttgaagtcaaggaccaacaaagcaagcaggctttagacctccaccatccaaagctcatgcccggcagtggactcgccctcgctccatctacctgcccccgctgcctctttcaggaaggagccccttaggaggacaggcctgcagcatcctggtctcgggaggcttctgtcattgctcacacacagttcagatttccacctctttatagacaagaagtgaatttgcctggggcagaacacccacccaaagagtccccacttaacaataccccccccccacggcaagaatgcccaaatccgaatgaccccagttttcctaatgagtaaaatgatcccagatgtgccccagagcatgacgcctgcagctccggtttcatgcaggaaattggttttggagagttttggcaagttggaaagccacttactggcttttgacatgacttctcttggagaataagtggactccaagctaactctttgcaaatgtaaacacatgtccatcttgtaataaatgcaaaatgcccgtgcagcagaagcatgcgactttcatatccttgcctagaataggctgcatggtgtatgtcagtgagggccacgaggcgtcggctttagacacagatcatagctctacaggagtttatgaatttgaagcttatgggattttggcagagaaattttcagctgtgcttgatacccaccaaaagaatgtatctcgaaagaatgaaggaagaagaaaaaaggatccttgatgtttgtgacaagaaaatgagaaagttagtatctgcaatacagagcttgttcctgttcagtgactgaccctctgtattctgtatagacaccaggccgatacacagtggagttcccaggccttgtttgcaggaagccgactgtaaagacagccccagctcaaggctattaggttgaatatttgctttcatgagtaaatgtggatctttggggaatggcttcaaaataagtcacgaacacaaattctttgtaaattatgtaaattcctgtttatataaattggcaacaacttataccgtctgacagttcaaaatctctttcagctgcgctcttcccaccgagccgagcttactgtgagtgtggagatgttatcccaccatgtaaagtcgcctgcgcaggggagggctgcccatctccccaacccagtcacagagagataggaaacggcatttgagtgggtgtccagggccccgtagagagacatttaagatggtgtatgacagagcattggccttgaccaaatgttaaatcctctgtgtgtatttcataagttattacaggtataaaagtgatgacctatcatgaggaaatgaaagtggctgatttgctggtaggattttgtacagtttagagaagcgattatttattgtgaaactgttctccactccaactcctttatgtggatctgttcaaagtagtcactgtatatacgtatagagaggtagataggtaggtagattttaaattgcattctgaatacaaactcatactccttagagcttgaattacatttttaaaatgcatatgtgctgtttggcaccgtggcaagatggtatcagagagaaacccatcaattgctcaaatactcagaaagtactgtcaaaagcctaataaaaaacctaaagtttgctctga

SEQ ID NO: 9523 - DNA, 2381 bp, Homo sapiens
ggggcgcggcggcggcggcgccagggtcggggccgcttccccattcgggcgcgagagccatggaggcgctgagggagtccgtgctgcatttggccttgcagatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagc

SEQ ID NO: 9524 - DNA, 3763 bp, Homo sapiens
gactctctgatgtttgggagcagatccgagcagctgagcagggtggctgttcctttcctggattagggctgaatctgtgggaaccagaccacccctgagacaggaggcagccctgatgcctctccagggcctgggcctgcagcggaaccccttcctccaagggaagcggggcccggggctcacgtcttccccgcccctcctgcctccttccctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaaca

SEQ ID NO: 9525 - DNA, 2484 bp, Homo sapiens
aggtggtgcaacgcctggcccggcccatcccatcccggccacccgggcagcgggaccaggcgtctggggcacagcatgcggggcgtgtggccgcccccggtgtccgccctgctgtcggcgctggggatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacc

SEQ ID NO: 9526 - DNA, 5099 bp, Homo sapiens
gagcgcgccgcctgggccaggcagccgagccgtccgagcagctgggctgggagcagggaacccggagctgggaatcgggagccgggcgcggggagctgcgcgaagccggggcggagcacgcgagctatgatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtagctgaagcagaagccagccgcagtccccttgccacatagaggcgggcttctcccagccatggtgtcccctctgcctcccctcccccgaccctcctgccttccgcgtggagggtggtggtcctgtagtgtcagcaccagcaccatgggcttggaccccctccctggacacaggcaggtgtcctagggctgggggtgcagcccgagggaatggagaccacactcatggctcaggtctgccggggccggcagggggttggggaagaagagggctcaggcccagcaggggtggaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtggcactattgtaatggaaataaaatacttgtacggagggc

SEQ ID NO: 9527 - DNA, 2328 bp, Homo sapiens
catcccatcccggccacccgggcagcgggaccaggcgtctggggcacagcatgcggggcgtgtggccgcccccggtgtccgccctgctgtcggcgctggggatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatcc

SEQ ID NO: 9528 - DNA, 2865 bp, Homo sapiens
ggcggcgggcgctgggagacaccggacgcccgctcggctgcgctgcggctcaggcccccgctcgggcccgacccgctcggtcaccgccggctcgggcgcgcacctgccggctgcggccccagggccatgcggaggcccacgaggaggccggcggccacgcgcatcccgtagcccaggtggcccaggtctgcaccgcggcggcctcggcgccatggagcccccgtattcgctgacggcgcactacgatgagttccaagaggtcaagtacgtgagccgctgcggcgcggggggcgcgcgcggggcctccctgcccccgggcttcccgttgggcgctgcgcgcagcgccaccggggcccggtccgggctgccgcgctggaaccggcgcgaggtgtgcctgctgtcggggctggtgttcgccgccggcctctgcgccattctggcggctatgctggccctcaagtacctgggcccggtcgcggccggcggcggcgcctgtcccgagggctgccctgagcgcaaggccttcgcgcgcgccgctcgcttcctggccgccaacctggacgccagcatcgacccatgccaggacttctactcgttcgcctgcggcggttggctgcggcgccacgccatccccgacgacaagctcacctatggcaccatcgcggccatcggcgagcaaaacgaggagcgcctacggcgcctgctggcgcggcccgggggtgggcctggcggcgcggcccagcgcaaggtgcgcgccttcttccgctcgtgcctcgacatgcgcgagatcgagcgactgggcccgcgacccatgctagaggtcatcgaggactgcgggggctgggacctgggcggcgcggaggagcgtccgggggtcgcggcgcgatgggacctcaaccggctgctgtacaaggcgcagggcgtgtacagcgccgccgcgctcttctcgctcacggtcagcctggacgacaggaactcctcgcgctacgtcatccgcattgaccaggatgggctcaccctgccagagaggaccctgtacctcgctcaggatgaggacagtgagaagatcctggcagcatacagggtgttcatggagcgagtgctcagcctcctgggtgcagacgctgtggaacagaaggcccaagagatcctgcaagtggagcagcagctggccaacatcactgtgtcagagcatgacgacctacggcgagatgtcagctccatgtacaacaaggtgacgctggggcagctgcagaagatcaccccccacttgcggtggaagtggctgctagaccagatcttccaggaggacttctcagaggaagaggaggtggtgctgctggcgacagactacatgcagcaggtgtcgcagctcatccgctccacaccccaccgggtcctgcacaactacctggtgtggcgcgtggtggtggtcctgagtgaacacctgtccccgccattccgtgaggcactgcacgagctggcacaggagatggagggcagcgacaagccacaggagctggcccgggtctgcttgggccaggccaatcgccactttggcatggcgcttggcgccctctttgtacatgagcacttctcagctgccagcaaagccaaggtgcagcagctagtggaagacatcaagtacatcctgggccagcgcctggaggagctggactggatggacgccgagaccagggctgctgctcgggccaagctccagtacatgatggtgatggtcggctacccggacttcctgctgaaacccgatgctgtggacaaggagtatgagtttgaggtccatgagaagacctacttcaagaacatcttgaacagcatccgcttcagcatccagctctcagttaagaagattcggcaggaggtggacaagtccacgtggctgctccccccacaggcgctcaatgcctactatctacccaacaagaaccagatggtgttccccgcgggcatcctgcagcccaccctgtacgaccctgacttcccacagtctctcaactacgggggcatcggcaccatcattggacatgagctgacccacggctacgacgactgggggggccagtatgaccgctcagggaacctgctgcactggtggacggaggcctcctacagccgcttcctgcgaaaggctgagtgcatcgtccgtctctatgacaacttcactgtctacaaccagcgggtgaacgggaaacacacgcttggggagaacatcgcagatatgggcggcctcaagctggcctaccacgcctatcagaagtgggtgcgggagcacggcccagagcacccacttccccggctcaagtacacacatgaccagctcttcttcattgcctttgcccagaactggtgcatcaagcggcggtcgcagtccatctacctgcaggtgctgactgacaagcatgcccctgagcactacagggtgctgggcagtgtgtcccagtttgaggagtttggccgggctttccactgtcccaaggactcacccatgaaccctgcccacaagtgttccgtgtggtgagcctggctgcccgcctgcacgcccccactgcccccgcacgaatcacctcctgctggctaccggggcaggcatgcacccggtgccagccccgctctgggcaccacctgccttccagcccctccaggacccggtccccctgctgcccctcacttcaggaggggcctggagcagggtgaggctggactttggggggctgtgagggaaatatactggggtccccagattctgctctaagggggccagaccctctgccaggctggattgtacgggccccaccttcgctgtgttcttgctgcaaagtctggtcaataaatcactgcactgtt

SEQ ID NO: 9529 - DNA, 2322 bp, Homo sapiens
atggagcccccgtattcgctgacggcgcactacgatgagttccaagaggtcaagtacgtgagccgctgcggcgcggggggcgcgcgcggggcctccctgcccccgggcttcccgttgggcgctgcgcgcagcgccaccggggcccggtccgggctgccgcgctggaaccggcgcgaggtgtgcctgctgtcggggctggtgttcgccgccggcctctgcgccattctggcggctatgctggccctcaagtacctgggcccggtcgcggccggcggcggcgcctgtcccgagggctgccctgagcgcaaggccttcgcgcgcgccgctcgcttcctggccgccaacctggacgccagcatcgacccatgccaggacttctactcgttcgcctgcggcggttggctgcggcgccacgccatccccgacgacaagctcacctatggcaccatcgcggccatcggcgagcaaaacgaggagcgcctacggcgcctgctggcgcggcccgggggtgggcctggcggcgcggcccagcgcaaggtgcgcgccttcttccgctcgtgcctcgacatgcgcgagatcgagcgactgggcccgcgacccatgctagaggtcatcgaggactgcgggggctgggacctgggcggcgcggaggagcgtccgggggtcgcggcgcgatgggacctcaaccggctgctgtacaaggcgcagggcgtgtacagcgccgccgcgctcttctcgctcacggtcagcctggacgacaggaactcctcgcgctacgtcatccgcattgaccaggatgggctcaccctgccagagaggaccctgtacctcgctcaggatgaggacagtgagaagatcctggcagcatacagggtgttcatggagcgagtgctcagcctcctgggtgcagacgctgtggaacagaaggcccaagagatcctgcaagtggagcagcagctggccaacatcactgtgtcagagcatgacgacctacggcgagatgtcagctccatgtacaacaaggtgacgctggggcagctgcagaagatcaccccccacttgcggtggaagtggctgctagaccagatcttccaggaggacttctcagaggaagaggaggtggtgctgctggcgacagactacatgcagcaggtgtcgcagctcatccgctccacaccccaccgggtcctgcacaactacctggtgtggcgcgtggtggtggtcctgagtgaacacctgtccccgccattccgtgaggcactgcacgagctggcacaggagatggagggcagcgacaagccacaggagctggcccgggtctgcttgggccaggccaatcgccactttggcatggcgcttggcgccctctttgtacatgagcacttctcagctgccagcaaagccaaggtgcagcagctagtggaagacatcaagtacatcctgggccagcgcctggaggagctggactggatggacgccgagaccagggctgctgctcgggccaagctccagtacatgatggtgatggtcggctacccggacttcctgctgaaacccgatgctgtggacaaggagtatgagtttgaggtccatgagaagacctacttcaagaacatcttgaacagcatccgcttcagcatccagctctcagttaagaagattcggcaggaggtggacaagtggctgctccccccacaggcgctcaatgcctactatctacccaacaagaaccagatggtgttccccgcgggcatcctgcagcccaccctgtacgaccctgacttcccacagtctctcaactacgggggcatcggcaccatcattggacatgagctgacccacggctacgacgactgggggggccagtatgaccgctcagggaacctgctgcactggtggacggaggcctcctacagccgcttcctgcgaaaggctgagtgcatcgtccgtctctatgacaacttcactgtctacaaccagcgggtgaacgggaaacacacgcttggggagaacatcgcagatatgggcggcctcaagctggcctaccacgcctatcagaagtgggtgcgggagcacggcccagagcacccacttccccggctcaagtacacacatgaccagctcttcttcattgcctttgcccagaactggtgcatcaagcggcggtcgcagtccatctacctgcaggtgctgactgacaagcatgcccctgagcactacagggtgctgggcagtgtgtcccagtttgaggagtttggccgggctttccactgtcccaaggactcacccatgaaccctgcccacaagtgttccgtgtggtga

SEQ ID NO: 9530 - DNA, 4135 bp, Homo sapiens
gtgctttttagtggccgcgtcccaggatagctggaaggttaggacgctcttgcggtcccagagtggagtggaaggtctggagctttgggaggagacggggaggacagactggaggcgtgttcctccggagttttctttttcgtgcgagccctcgcgcgcgcgtacagtcatcccgctggtctgacgattgtggagaggcggtggagaggcttcatccatcccacccggtcgtcgccggggattggggtcccagcgagacctccccgggagaagcagtgcccaggaggttttctgaagccggggaagctgtgcagccgaagccgccgccgcgccggagcccgggacaccggccaccctccgcgccacccaccctcgccggctccggcttcctctggcccaggcgccgcgcggacccggcagctgtctgcgcacgccgagctccacggtgaaaaaaaagtgaaggtgtaaaagcagcacaagtgcaataagagatatttcctcaaatttgcctcaagatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagctgctggctgggcgctggccttttgatcacaatgactttggcgtatttctttgcaagctgttcccctttttgcagaagtcctcggtggggatcaccgtcctcaacctctgcgctcttagtgttgacaggtacagagcagttgcctcctggagtcgtgttcagggaattgggattcctttggtaactgccattgaaattgtctccatctggatcctgtcctttatcctggccattcctgaagcgattggcttcgtcatggtaccctttgaatataggggtgaacagcataaaacctgtatgctcaatgccacatcaaaattcatggagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcatttaagccgtatattgaagaaaactgtgtataacgagatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgggaatctcttctctgatccttcttccttaattcactcccacacccaagaagaaatgctttccaaaaccgcaagggtagactggtttatccacccacaacatctacgaatcgtacttctttaattgatctaatttacatattctgcgtgttgtattcagcactaaaaaatggtgggagctgggggagaatgaagactgttaaatgaaaccagaaggatatttactacttttgcatgaaaatagagctttcaagtacatggctagcttttatggcagttctggtgaatgttcaatgggaactggtcaccatgaaactttagagattaacgacaagattttctactttttttaagtgatttttttgtccttcagccaaacacaatatgggctcaagtcacttttatttgaaatgtcatttggtgccagtattttttaactgcataatagcctaacatgattatttgaacttatttacacatagtttgaaaaaaaaaagacaaaaatagtattcaggtgagcaattagattagtattttccacgtcactgtttatttttttaaaacacaaattctaaagctacaacaaatactacaggcccttaaagcacagtctgatgacacatttggcagtttaatagatgttactcaaagaattttttaagaactgtattttattttttaaatggtgttttattacaagggaccttgaacatgttttgtatgttaaattcaaaagtaatgcttcaatcagatagttctttttcacaagttcaatctgtttttcatgtaaattttgtatgaaaaatcaatgtcaagtaccaaaatgttaatgtatgtgtcatttaactctgcctgagactttcagtgcactgtatatagaagtctaaaacacacctaagagaaaaagatcgaatttttcagatgattcagaaattttcattcaggtatttgtaatagtgacatatatatgtatatacatatcacctcctattctcttaatttttcttaaaatgttaactggcagtaagtcttttttgatcattcccttttccatataggaaacataattttgaagtggccagatgagtttatcatgtcagtgaaaaataattacccacaaatgccaccagaacttacgattcttcacttcttggggttttcagtatgaacctaactccccaccccaacatctccctcccacattgtcaccatttcaaagggcccacagtgacttttgctgggcattttcccagatgtttacagactgtgagtacagcagaaaatcttttactagtgtgtgtgtgtatatatataaacaattgtaaatttcttttagcccatttttctagactgtctctgtggaatatatttgtgtgtgtgatatatgcatgtgtgtgatggtatgtatggatttaatctaatctaataattgtgccccgcagttgtgccaaagtgcatagtctgagtaaaatctaggtgattgttcatcatgacaacctgcctcagtccattttaacctgtagcaaccttctgcattcataaatcttgtaatcatgttaccattacaaatgggatataagaggcagcgtgaaagcagatgagctgtggactagcaatatagggttttgtttggttggttggtttgataaagcagtatttggggtcatattgtttcctgtgctggagcaaaagtcattacactttgaagtattatattgttcttatcctcaattcaatgtggtgatgaaattgccaggttgtctgatatttctttcagacttcgccagacagattgctgataataaattaggtaagataatttgttgggccatattttaggacaggtaaaataacatcaggttccagttgcttgaattgcaaggctaagaagtactgcccttttgtgtgttagcagtcaaatctattattccactggcgcatcatatgcagtgatatatgcctataatataagccataggttcacaccattttgtttagacaattgtctttttttcaagatgctttgtttctttcatatgaaaaaaatgcattttataaattcagaaagtcatagatttctgaaggcgtcaacgtgcattttatttatggactggtaagtaactgtggtttactagcaggaatatttccaatttctacctttactacatcttttcaacaagtaactttgtagaaatgagccagaagccaaggccctgagttggcagtggcccataagtgtaaaataaaagtttacagaaaccttg

SEQ ID NO: 9531 - DNA, 4022 bp, Homo sapiens
gggggcggcagctttgtgctttttagtggccgcgtcccaggatagctggaaggttaggacgctcttgcggtcccagagtggagtggaaggtctggagctttgggaggagacggggaggacagactggaggcgtgttcctccggagttttctttttcgtgcgagccctcgcgcgcgcgtacagtcatcccgctggtctgacgattgtggagaggcggtggagaggcttcatccatcccacccggtcgtcgccggggattggggtcccagcgagacctccccgggagaagcagtgcccaggaggttttctgaagccggggaagctgtgcagccgaagccgccgccgcgccggagcccgggacaccggccaccctccgcgccacccaccctcgccggctccggcttcctctggcccaggcgccgcgcggacccggcagctgtctgcgcacgccgagctccacggtgaaaaaaaagtgaaggtgtaaaagcagcacaagtgcaataagagatatttcctcaaatttgcctcaagatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaaggtacagagcagttgcctcctggagtcgtgttcagggaattgggattcctttggtaactgccattgaaattgtctccatctggatcctgtcctttatcctggccattcctgaagcgattggcttcgtcatggtaccctttgaatataggggtgaacagcataaaacctgtatgctcaatgccacatcaaaattcatggagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcatttaagccgtatattgaagaaaactgtgtataacgagatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgggaatctcttctctgatccttcttccttaattcactcccacacccaagaagaaatgctttccaaaaccgcaagggtagactggtttatccacccacaacatctacgaatcgtacttctttaattgatctaatttacatattctgcgtgttgtattcagcactaaaaaatggtgggagctgggggagaatgaagactgttaaatgaaaccagaaggatatttactacttttgcatgaaaatagagctttcaagtacatggctagcttttatggcagttctggtgaatgttcaatgggaactggtcaccatgaaactttagagattaacgacaagattttctactttttttaagtgatttttttgtccttcagccaaacacaatatgggctcaagtcacttttatttgaaatgtcatttggtgccagtattttttaactgcataatagcctaacatgattatttgaacttatttacacatagtttgaaaaaaaaaagacaaaaatagtattcaggtgagcaattagattagtattttccacgtcactgtttatttttttaaaacacaaattctaaagctacaacaaatactacaggcccttaaagcacagtctgatgacacatttggcagtttaatagatgttactcaaagaattttttaagaactgtattttattttttaaatggtgttttattacaagggaccttgaacatgttttgtatgttaaattcaaaagtaatgcttcaatcagatagttctttttcacaagttcaatctgtttttcatgtaaattttgtatgaaaaatcaatgtcaagtaccaaaatgttaatgtatgtgtcatttaactctgcctgagactttcagtgcactgtatatagaagtctaaaacacacctaagagaaaaagatcgaatttttcagatgattcagaaattttcattcaggtatttgtaatagtgacatatatatgtatatacatatcacctcctattctcttaatttttcttaaaatgttaactggcagtaagtcttttttgatcattcccttttccatataggaaacataattttgaagtggccagatgagtttatcatgtcagtgaaaaataattacccacaaatgccaccagaacttacgattcttcacttcttggggttttcagtatgaacctaactccccaccccaacatctccctcccacattgtcaccatttcaaagggcccacagtgacttttgctgggcattttcccagatgtttacagactgtgagtacagcagaaaatcttttactagtgtgtgtgtgtatatatataaacaattgtaaatttcttttagcccatttttctagactgtctctgtggaatatatttgtgtgtgtgatatatgcatgtgtgtgatggtatgtatggatttaatctaatctaataattgtgccccgcagttgtgccaaagtgcatagtctgagtaaaatctaggtgattgttcatcatgacaacctgcctcagtccattttaacctgtagcaaccttctgcattcataaatcttgtaatcatgttaccattacaaatgggatataagaggcagcgtgaaagcagatgagctgtggactagcaatatagggttttgtttggttggttggtttgataaagcagtatttggggtcatattgtttcctgtgctggagcaaaagtcattacactttgaagtattatattgttcttatcctcaattcaatgtggtgatgaaattgccaggttgtctgatatttctttcagacttcgccagacagattgctgataataaattaggtaagataatttgttgggccatattttaggacaggtaaaataacatcaggttccagttgcttgaattgcaaggctaagaagtactgcccttttgtgtgttagcagtcaaatctattattccactggcgcatcatatgcagtgatatatgcctataatataagccataggttcacaccattttgtttagacaattgtctttttttcaagatgctttgtttctttcatatgaaaaaaatgcattttataaattcagaaagtcatagatttctgaaggcgtcaacgtgcattttatttatggactggtaagtaactgtggtttactagcaggaatatttccaatttctacctttactacatcttttcaacaagtaactttgtagaaatgagccagaagccaaggccctgagttggcagtggcccataagtgtaaaataaaagtttacagaaaccttg

SEQ ID NO: 9532 - DNA, 3823 bp, Homo sapiens
gggggcggcagctttgtgctttttagtggccgcgtcccaggatagctggaaggttaggacgctcttgcggtcccagagtggagtggaaggtctggagctttgggaggagacggggaggacagactggaggcgtgttcctccggagttttctttttcgtgcgagccctcgcgcgcgcgtacagtcatcccgctggtctgacgattgtggagaggcggtggagaggcttcatccatcccacccggtcgtcgccggggattggggtcccagcgagacctccccgggagaagcagtgcccaggaggttttctgaagccggggaagctgtgcagccgaagccgccgccgcgccggagcccgggacaccggccaccctccgcgccacccaccctcgccggctccggcttcctctggcccaggcgccgcgcggacccggcagctgtctgcgcacgccgagctccacggtgaaaaaaaagtgaaggtgtaaaagcagcacaagtgcaataagagatatttcctcaaatttgcctcaagatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcatttaagccgtatattgaagaaaactgtgtataacgagatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgggaatctcttctctgatccttcttccttaattcactcccacacccaagaagaaatgctttccaaaaccgcaagggtagactggtttatccacccacaacatctacgaatcgtacttctttaattgatctaatttacatattctgcgtgttgtattcagcactaaaaaatggtgggagctgggggagaatgaagactgttaaatgaaaccagaaggatatttactacttttgcatgaaaatagagctttcaagtacatggctagcttttatggcagttctggtgaatgttcaatgggaactggtcaccatgaaactttagagattaacgacaagattttctactttttttaagtgatttttttgtccttcagccaaacacaatatgggctcaagtcacttttatttgaaatgtcatttggtgccagtattttttaactgcataatagcctaacatgattatttgaacttatttacacatagtttgaaaaaaaaaagacaaaaatagtattcaggtgagcaattagattagtattttccacgtcactgtttatttttttaaaacacaaattctaaagctacaacaaatactacaggcccttaaagcacagtctgatgacacatttggcagtttaatagatgttactcaaagaattttttaagaactgtattttattttttaaatggtgttttattacaagggaccttgaacatgttttgtatgttaaattcaaaagtaatgcttcaatcagatagttctttttcacaagttcaatctgtttttcatgtaaattttgtatgaaaaatcaatgtcaagtaccaaaatgttaatgtatgtgtcatttaactctgcctgagactttcagtgcactgtatatagaagtctaaaacacacctaagagaaaaagatcgaatttttcagatgattcagaaattttcattcaggtatttgtaatagtgacatatatatgtatatacatatcacctcctattctcttaatttttcttaaaatgttaactggcagtaagtcttttttgatcattcccttttccatataggaaacataattttgaagtggccagatgagtttatcatgtcagtgaaaaataattacccacaaatgccaccagaacttacgattcttcacttcttggggttttcagtatgaacctaactccccaccccaacatctccctcccacattgtcaccatttcaaagggcccacagtgacttttgctgggcattttcccagatgtttacagactgtgagtacagcagaaaatcttttactagtgtgtgtgtgtatatatataaacaattgtaaatttcttttagcccatttttctagactgtctctgtggaatatatttgtgtgtgtgatatatgcatgtgtgtgatggtatgtatggatttaatctaatctaataattgtgccccgcagttgtgccaaagtgcatagtctgagtaaaatctaggtgattgttcatcatgacaacctgcctcagtccattttaacctgtagcaaccttctgcattcataaatcttgtaatcatgttaccattacaaatgggatataagaggcagcgtgaaagcagatgagctgtggactagcaatatagggttttgtttggttggttggtttgataaagcagtatttggggtcatattgtttcctgtgctggagcaaaagtcattacactttgaagtattatattgttcttatcctcaattcaatgtggtgatgaaattgccaggttgtctgatatttctttcagacttcgccagacagattgctgataataaattaggtaagataatttgttgggccatattttaggacaggtaaaataacatcaggttccagttgcttgaattgcaaggctaagaagtactgcccttttgtgtgttagcagtcaaatctattattccactggcgcatcatatgcagtgatatatgcctataatataagccataggttcacaccattttgtttagacaattgtctttttttcaagatgctttgtttctttcatatgaaaaaaatgcattttataaattcagaaagtcatagatttctgaaggcgtcaacgtgcattttatttatggactggtaagtaactgtggtttactagcaggaatatttccaatttctacctttactacatcttttcaacaagtaactttgtagaaatgagccagaagccaaggccctgagttggcagtggcccataagtgtaaaataaaagtttacagaaaccttg

SEQ ID NO: 9533 - DNA, 1091 bp, Homo sapiens
gggggcggcagctttgtgctttttagtggccgcgtcccaggatagctggaaggttaggacgctcttgcggtcccagagtggagtggaaggtctggagctttgggaggagacggggaggacagactggaggcgtgttcctccggagttttctttttcgtgcgagccctcgcgcgcgcgtacagtcatcccgctggtctgacgattgtggagaggcggtggagaggcttcatccatcccacccggtcgtcgccggggattggggtcccagcgagacctccccgggagaagcagtgcccaggaggttttctgaagccggggaagctgtgcagccgaagccgccgccgcgccggagcccgggacaccggccaccctccgcgccacccaccctcgccggctccggcttcctctggcccaggcgccgcgcggacccggcagctgtctgcgcacgccgagctccacggtgaaaaaaaagtgaaggtgtaaaagcagcacaagtgcaataagagatatttcctcaaatttgcctcaagatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagctgctggctgggcgctggccttttgatcacaatgactttggcgtatttctttgcaagctgttcccctttttgcagaagtcctcggtggggatcaccgtcctcaacctctgcgctcttagtgttgacagaaagactgaaatg

SEQ ID NO: 9534 - DNA, 1032 bp, Homo sapiens
atggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcatttaagccgtatattgaagaaaactgtgtataacgagatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgg

SEQ ID NO: 9535 - DNA, 2438 bp, Homo sapiens
cgattaaaggcgctgccagcctcacgctctgggcacagctgagcgtgacactcggggaagtcaaacccctcactactgcctaggaagatggctagactttaaatactatttttttccctttaagaaaaaaattattggagctttttttcttgctttctttttccttttctttttctttttttccttcatttttttggccgtggcttactccccatttaaatcaaatcattgaatctggttgcagaaagaaaaaagaaatagccaagtgtctccatatctggatgtctacaaattagagagggagagacagcgagatctatctgctagataagaacgagcgatccaggccagacgcctgagcttttttcctgcacccgccccgtgccttcgctgaggcttcgcctgcctccttcctccgcgcacccccacgggccgctggcaaagtggggtggggagcgaggcggtgggggcgggggccggcgcggcggccggggcggcggggcggccgagcatggaagaacagcagccggaacctaaaagtcagcgcgactcggccctcggcgcggcggcggcggcgactccgggcggcctcagcctgagcctcagtccgggcgccagcggcagcagcggcagcggcagcgatggagacagcgtgccggtgtccccgcagcctgcgcccccctcgccgcccgcggcgccttgcctgccgcccctggcccaccacccgcacctccccccacaccccccgcccccgccgcctcagcatctcgcggcgcctgctcaccagccgcagccagcggcccagctgcaccgcaccaccaactttttcatcgacaacatcctgaggccggacttcggctgcaaaaaggagcagccgccaccgcagcttctggtggctgcggcggccagaggaggcgcaggaggaggaggccgggtcgagcgtgacagaggccagactgccgcaggtagagaccctgtccacccgttgggcacccgggcgccaggcgctgcctcgctcctgtgcgccccggacgcgaactgtggcccacccgacggctcccagccagccgccgccggcgcgggcgcgtctaaagctgggaacccggctgcggcggcggcggcggccgcggcggcagtggcggcggcggcggcggccgcagcagccaagccctcggacaccggtggcggcggcagtggaggcggcgcggggagccccggagcgcagggcaccaaatacccggagcacggcaacccggctatcctacttatgggctcagccaacggcgggcccgtggtcaaaactgactcgcagcagcctctcgtatggcccgcctgggtgtactgcacacgttattcggatcgtccatcctccggtccgcgcaccaggaagctgaagaagaagaagaacgagaaggaggacaagcggccgcggaccgcgttcacggccgagcagctgcagagactcaaggcggagttccaggcaaaccgctacatcacggagcagcggcggcagaccctggcccaggaactcagcctcaacgagtcccagatcaagatctggttccagaacaagcgcgccaagatcaagaaagccacaggcatcaagaacggcctggcgctgcacctcatggcccagggactgtacaaccactccaccaccacggtccaggacaaagacgagagcgagtagccgccacaggccggggccgcgcccgcgccccctcccggcaccgccgccgtcgtctcccggcccctcgctgggggagaaagcatctgctccaaggagggagggagcgcagggaaaagagcgagagagacagaaagagagcctcagaatggacaatgacgttgaaacgcagcatttttgaaaagggagaaagactcggacaggtgctatcgaaaaataagatccattctctattcccagtataagggacgaaactgcgaactccttaaagctctatctagccaaaccgcttacgaccttgtatatatttaatttcaggtaaggaaaacacatacgtgtagcgatctctatttgctggacatttttattaatctcctttattattattgttataattattataattattataattattttatcccctcccccaccgcctcgctgcccccgcccagtttcgttttcgttgcctttttcatttgaatgtcattgcttctccggtgcctcccgacccgcatcgccggccctggtttctctgggacttttctttgtgtgcgagagtgtgtttcctttcgtgtctgcccacctcttctcccccacctcccgggtcccttctgtcggtctgtctgttctgcccccctttcgttttccggagacttgttgagaaatacgaccccacagactgcgagactgaaccgccgctacaagccaaagattttattatgttcagaaacctgtagtctgaaataaa

SEQ ID NO: 9536 - DNA, 3395 bp, Homo sapiens
tctctcatcgtctgggcgagcggggcggctcgtggtgtttctaacccagttcgtggattcaaaggtggctccgcgccgagcgcggccggcgacttgtaggacctcagccctggccgcggccgccgcgcacgccctcggaagactcggcggggtgggggcgcgggggtctccgtgtgcgccgcgggagggccgaaggctgatttggaagggcgtccccggagaaccagtgtgggatttactgtgaacagcatggaggagaatgaccccaagcctggcgaagcagcggcggcggtggagggacagcggcagccggaatccagccccggcggcggctcgggcggcggcggcggtagcagcccgggcgaagcggacaccgggcgccggcgggctctgatgctgcccgcggtcctgcaggcgcccggcaaccaccagcacccgcaccgcatcaccaacttcttcatcgacaacatcctgcggcccgagttcggccggcgaaaggacgcggggacctgctgtgcgggcgcgggaggaggaaggggcggcggagccggcggcgaaggcggcgcgagcggtgcggagggaggcggcggcgcgggcggctcggagcagctcttgggctcgggctcccgagagccccggcagaacccgccatgtgcgcccggcgcgggcgggccgctcccagccgccggcagcgactctccgggtgacggggaaggcggctccaagacgctctcgctgcacggtggcgccaagaaaggcggcgaccccggcggccccctggacgggtcgctcaaggcccgcggcttgggcggcggcgacctgtcggtgagctcggactcggacagctcgcaagccggcgccaacctgggcgcgcagcccatgctctggccggcgtgggtctactgtacgcgctactcggaccggccttcttcaggtcccaggtctcgaaaaccaaagaagaagaacccgaacaaagaggacaagcggccgcgcacggcctttaccgccgagcagctgcagaggctcaaggccgagttccagaccaacaggtacctgacggagcagcggcgccagagcctggcgcaggagctgagcctcaacgagtcacagatcaagatttggttccagaacaagcgcgccaagatcaagaaggccacgggcaacaagaacacgctggccgtgcacctcatggcacagggcttgtacaaccactccaccacagccaaggagggcaagtcggacagcgagtagggcggggggcatggaggccaggtctcagtccgcgctaaacaatgcaataatttaaaatcataaagggccagtgtataaagattataccagcattaatagtgaaaatattgtgtattagctaaggttctgaaatattctatgtatatatcatttacaggtggtataaaatccaaaatatctgactataaaatatttttttgagttttttgtgtttatgagattatgctaattttatgggtttttttcttttttgcgaagggggctgcttagggtttcacctttttttaatcccctaagctccattatatgacattggacacttttttattattccaaaagaagaaaaaattaaaacaacttgctgaagtccaaagattttttattgctgcatttcacacaactgtgaaccgaataaatagctcctatttggtctatgacttctgccactttgtttgtgttggcttggtgaggacagcaggaggggcccacacctcaagcctggaccagccacctcaaggccttggggagcttaggggacctggtgggagagaggggacttccagggtccttgggccagttctgggatttggccctgggaagcagcccagcgtaccccaggcctgctctgggaagtcggctccatgctcaccagcagccgcccaggcccgcagcctcacccggctccctctcctcaccctcctgcacctaactccctcctccttctcctttttcctcctcttcctccttcctccttcctcctgctcctcctttcttcttctttttcttctcctcctcctccttccttcctcctcctccttctctttcctcctcctcctcaccaagggcccaaccgtgtgcatacatcgtctgcgtctgtggtctgtgtcgctgtccccagtcccaccgcagtcctgccgcaggcctaaccctcctgccctgggcactgcctccatgcagaagcgcttcgaggttctggggctaaaggcctggggtgtgtggcctaaagcccaagagcggtggggcgaccctccttttggcttggccccaggaatttcctgtgactccaccagccatcatgggtgccagccagggtcccagaaatgaggccatggctcactgtttctgggcgggcagaaggctctgtagagggagatggcatcatctatcttcctttcctttttcttttcttccctatttttttctttttttcctttatttttttcttttcttggagtggctgcttctgctatagagaacattcttccaagataaatatgtgtgtttacacatatgtctgcatgcatgtgaacacacacacacacacacacacaccaggcgtgtttgagtccacagttctgaaacatgtggctaccttgtctttcaaaagaactcagaatcctccaggatctagaagaaggaagaaagtgtgtaaataatcatttcttatcatcactttttgtcttttcttgttttttaaaatatacattttatttttgaaggtgtggtacagtgtaaattaaatatattcaatatatttcccaccaagtacctatatatgtatataaacaaacacattatctatatataacgccacactgtcttctgtttagtgtatggggaaagaccaatccaactgtccatctgtggctgggacagcccagggggtgtgcccacggctgacccaggggtgtgcacacggctgagctgggagtcccgctggtctccctgaggactgagggtgaacttcgctctttgccttaaacctctttatttcattgcagtaatagttttacgttgtacataatagtgtaaacctttttaaaaaggaaagtataaaaacaaaagttgtaatttaaaagtctgaataaccatctgctgcttaggaaactcaatgaaatgacatgcctttttagcaggaagcaaagttggtttctgttttttgttttctttgttgttttagtttataaaacatgtgcattttacagttccagtatcaaatatttataatcttatgagaaatgaatgaatgtttctatttacaactgtgcttatcaaaattgtgaacacccccacccccgcatttttgtgtgttgaaattcttgaaggttacattaaataaaacaaaatctctttattataaaata

SEQ ID NO: 9537 - DNA, 4022 bp, Homo sapiens
aattagtgcctccaaacgccgtgtgtgagctcatcgaagtcatgctctgcacacatattatttatagcagatctgaggcatgcatggtgtttgacatttctgtcttttaagtagggggacttcaaaaagtcgtgggcatccccctaggcaaagtgcagtgggcagggaccaggcagggtgcgggcgcaaggcgaacgcgcagaccacgagtgtcctggcgcaggtgccgggggcggcggctgcaactccgcagcgtccgctcgggaggagagttcgcggctgatctccggatgccttgcagatgcaaaatgtgtctctggccagcaggaggaaggaagaggaagtgagagcagcggcagccggcggtgcagcagccggccgacccagagtgtaagtgcgtgtgctggggcgagcgggagcgggcgaggatgggcacaggatagaggcagagccacccacgccgccgcggccccacgctgggcgacagagcctccagttccccttcaatggtggcgggtcgccggagctctgatcgccgggaacccttgccgctgctgtcctgcgaccccaagcaggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagctcagaacgcccagcagctccatgaacgaatccagtcctcgagtatggatgccaagctggaagccctgaaggacttggccagcctctcccgggatgtcacgtttgcccaggagtttataaacctggacggtatctctctcctcacgcagatggtggagagcggcactgagcgataccagaaattgcagaagatcatgaagccttgctttggagacatgctgtccttcaccctgacggccttcgttgagctgatggaccatggcatagtgtcctgggatacattttcggtggcgttcattaagaagatagcaagttttgtgaacaagtcagccatagacatctcgatcctgcagcggtccttggccattttggagtcgatggtgctcaatagccatgacctctaccagaaagtggcgcaggagatcaccatcggccagctcattccacacctgcaagggtcagatcaagaaatccaaacctatactattgcagtgattaatgcgcttttcctgaaggctcctgatgagaggaggcaggagatggcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattaatcatgtcaaccctgccatggacttcacgcagactccacctgggatgttggctctggacaacatgctgtactttgccaagcaccaccaagatgcctacatccggattgtgcttgagaacagtagtcgagaagacaagcatgaatgtccctttggccgcagtagtatagagctgaccaagatgctatgtgagatcttgaaagtgggcgagttgcctagtgagacctgcaacgacttccacccgatgttcttcacccacgacagatcctttgaggagtttttctgcatctgtatccagctcctgaacaagacatggaaggaaatgagggcaacttctgaagacttcaacaaggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacaggagagaggaatgaaaacacacccacgccttggaaccgtcctttggtaaagggaagctgtgggtccacattcccttcagcatcacctctagccctggcaactttcagcccctagctggcatcttgctcaccgccctgattctgttcctcggctccactgcttcaggtcacttcccatggctgcagtccactggtgggacaagagcaaagcccactgccagtaagaaggccaaagggcccttccatcctagccctctgcaggcatgcccttccttcccttgggcaggaaagccagcagccccagactgcccaaaaacttgcccaccagaccaagggcagtgccccaaggcccctgtctggaggaaatggcctagctatttgatgagaagaccaaaccccacatcctcctttcccctctctctagaatcatctcgcaccaccagttacacttgaattaagatctgcgctcaaatctcctcccacctctctccctgcttttgccttgctctgttcctctttggtcccaagagcagcagccgcagcctcctcgtgatcctccctagcataaatttcccaaacagtccacaggtcccatgcccactttgcgtctgcactgtgatcgtgacaaatcttccctcctcaccagctagtctggggtttcctctccctgccccaggccagaactgccttcttcatttccacccacgctcccagcctcttagctgaaagcacaaatggtgaaatcagtagtctcgctccatctctaatagactaaacctaaatgcctctaggacggactgttgctatccaagcgtttggtgttaccttctcctgggaggtcctgctgcaactcaagttccacaggatggtcaagctgtcagacatccaagtttacatcattgtaattattactggtatttacaatttgcaagagttttgggttagtttttttttttttttttgctttgtttttgtacaaaagagtctaacattttttgccaaacagatatatatttaatgaaaagaagagatacataaatgtgtgaatttccagtttttttttaattattttaatcccaaacatcttcctgaaaataacattcccttaaacatgctgtggaataaaatggattgtgatga

SEQ ID NO: 9538 - DNA, 2485 bp, Homo sapiens
atgtccgaacatcagaaggaacaaactctggacacaccatctttaagaactgtaacactcactgtgagggtccatggcttcattcttgaagtcagcaagaccaagaacccaccaattccagacacattttggccacccagatgggaccatcgcccatcgccaggcggtgagactaatgcctattgccaaatgaatcatgtcaaccctgccatggacttcacgcagactccacctgggatgttggctctggacaacatgctgtactttgccaagcaccaccaagatgcctacatccggattgtgcttgagaacagtagtcgagaagacaagcatgaatgtccctttggccgcagtagtatagagctgaccaagatgctatgtgagatcttgaaagtgggcgagttgcctagtgagacctgcaacgacttccacccgatgttcttcacccacgacagatcctttgaggagtttttctgcatctgtatccagctcctgaacaagacatggaaggaaatgagggcaacttctgaagacttcaacaaggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacaggagagaggaatgaaaacacacccacgccttggaaccgtcctttggtaaagggaagctgtgggtccacattcccttcagcatcacctctagccctggcaactttcagcccctagctggcatcttgctcaccgccctgattctgttcctcggctccactgcttcaggtcacttcccatggctgcagtccactggtgggacaagagcaaagcccactgccagtaagaaggccaaagggcccttccatcctagccctctgcaggcatgcccttccttcccttgggcaggaaagccagcagccccagactgcccaaaaacttgcccaccagaccaagggcagtgccccaaggcccctgtctggaggaaatggcctagctatttgatgagaagaccaaaccccacatcctcctttcccctctctctagaatcatctcgcaccaccagttacacttgaattaagatctgcgctcaaatctcctcccacctctctccctgcttttgccttgctctgttcctctttggtcccaagagcagcagccgcagcctcctcgtgatcctccctagcataaatttcccaaacagtccacaggtcccatgcccactttgcgtctgcactgtgatcgtgacaaatcttccctcctcaccagctagtctggggtttcctctccctgccccaggccagaactgccttcttcatttccacccacgctcccagcctcttagctgaaagcacaaatggtgaaatcagtagtctcgctccatctctaatagactaaacctaaatgcctctaggacggactgttgctatccaagcgtttggtgttaccttctcctgggaggtcctgctgcaactcaagttccacaggatggtcaagctgtcagacatccaagtttacatcattgtaattattactggtatttacaatttgcaagagttttgggttagtttttttttttttttttgctttgtttttgtacaaaagagtctaacattttttgccaaacagatatatatttaatgaaaagaagagatacataaatgtgtgaatttccagtttttttttaattattttaatcccaaacatcttcctgaaaataacattcccttaaacatgctgtggaataaaatggattgtgatgatttgg

SEQ ID NO: 9539 - DNA, 2948 bp, Homo sapiens
aatacaaagcatgcttgtgagacagaattcctccttagacatgccggtcaacttacagaagagaaccgcaatgagataaaaaatggcactatccttcgattaaccacatctccagctcagaacgcccagcagctccatgaacgaatccagtcctcgagtatggatgccaagctggaagccctgaaggacttggccagcctctcccgggatgtcacgtttgcccaggagtttataaacctggacggtatctctctcctcacgcagatggtggagagcggcactgagcgataccagaaattgcagaagatcatgaagccttgctttggagacatgctgtccttcaccctgacggccttcgttgagctgatggaccatggcatagtgtcctgggatacattttcggtggcgttcattaagaagatagcaagttttgtgaacaagtcagccatagacatctcgatcctgcagcggtccttggccattttggagtcgatggtgctcaatagccatgacctctaccagaaagtggcgcaggagatcaccatcggccagctcattccacacctgcaagggtcagatcaagaaatccaaacctatactattgcagtgattaatgcgcttttcctgaaggctcctgatgagaggaggcaggagatggcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattaatcatgtcaaccctgccatggacttcacgcagactccacctgggatgttggctctggacaacatgctgtactttgccaagcaccaccaagatgcctacatccggattgtgcttgagaacagtagtcgagaagacaagcatgaatgtccctttggccgcagtagtatagagctgaccaagatgctatgtgagatcttgaaagtgggcgagttgcctagtgagacctgcaacgacttccacccgatgttcttcacccacgacagatcctttgaggagtttttctgcatctgtatccagctcctgaacaagacatggaaggaaatgagggcaacttctgaagacttcaacaaggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgcccttccttcccttgggcaggaaagccagcagccccagactgcccaaaaacttgcccaccagaccaagggcagtgccccaaggcccctgtctggaggaaatggcctagctatttgatgagaagaccaaaccccacatcctcctttcccctctctctagaatcatctcgcaccaccagttacacttgaattaagatctgcgctcaaatctcctcccacctctctccctgcttttgccttgctctgttcctctttggtcccaagagcagcagccgcagcctcctcgtgatcctccctagcataaatttcccaaacagtccacaggtcccatgcccactttgcgtctgcactgtgatcgtgacaaatcttccctcctcaccagctagtctggggtttcctctccctgccccaggccagaactgccttcttcatttccacccacgctcccagcctcttagctgaaagcacaaatggtgaaatcagtagtctcgctccatctctaatagactaaacctaaatgcctctaggacggactgttgctatccaagcgtttggtgttaccttctcctgggaggtcctgctgcaactcaagttccacaggatggtcaagctgtcagacatccaagtttacatcattgtaattattactggtatttacaatttgcaagagttttgggttagtttttttttttttttttgctttgtttttgtacaaaagagtctaacattttttgccaaacagatatatatttaatgaaaagaagagatacataaatgtgtgaatttccagtttttttttaattattttaatcccaaacatcttcctgaaaataacattcccttaaacatgctgtggaataaaatggattgtgatg

SEQ ID NO: 9540 - DNA, 1982 bp, Homo sapiens
tggaggggcagcgtggggaacgagaaactctttgcctgtagggacccttctagctgcaaacttaaaaatgtatgtggcaagatgcaacccaagcaccgagcaggattccagacgagttataatcattctgaacggggagaggaaaggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacaggagagaggaatgaaaacacacccacgccttggaaccgtcctttggtaaagggaagctgtgggtccacattcccttcagcatcacctctagccctggcaactttcagcccctagctggcatcttgctcaccgccctgattctgttcctcggctccactgcttcaggtcacttcccatggctgcagtccactggtgggacaagagcaaagcccactgccagtaagaaggccaaagggcccttccatcctagccctctgcaggcatgcccttccttcccttgggcaggaaagccagcagccccagactgcccaaaaacttgcccaccagaccaagggcagtgccccaaggcccctgtctggaggaaatggcctagctatttgatgagaagaccaaaccccacatcctcctttcccctctctctagaatcatctcgcaccaccagttacacttgaattaagatctgcgctcaaatctcctcccacctctctccctgcttttgccttgctctgttcctctttggtcccaagagcagcagccgcagcctcctcgtgatcctccctagcataaatttcccaaacagtccacaggtcccatgcccactttgcgtctgcactgtgatcgtgacaaatcttccctcctcaccagctagtctggggtttcctctccctgccccaggccagaactgccttcttcatttccacccacgctcccagcctcttagctgaaagcacaaatggtgaaatcagtagtctcgctccatctctaatagactaaacctaaatgcctctaggacggactgttgctatccaagcgtttggtgttaccttctcctgggaggtcctgctgcaactcaagttccacaggatggtcaagctgtcagacatccaagtttacatcattgtaattattactggtatttacaatttgcaagagttttgggttagtttttttttttttttttgctttgtttttgtacaaaagagtctaacattttttgccaaacagatatatatttaatgaaaagaagagatacataaa

SEQ ID NO: 9541 - DNA, 2524 bp, Homo sapiens
tgatgaatatgaactatctccagcccatcaccagctttttctttttcttcttgtccttatttgttttttagttctttataagaaaaagtgggggatatattgagaagtaccaagacggggagctatgggtttattgacaaaagagcataggacactaaaatagaaacgaagttattatttttctcttgtgatactctaagagaaaagctcttcctggaaaagccgatgatctctgaagatgctaaataaatgagcaggagtttccctgaaatggaggcgccctttgattggctgatctttccccgactcctgccaatcggagcatccctgggctccagctccataaacataagcaaagctacatgcttattcttctggacttggagtgtataccatttaaaggtgtgcggcgggtctctgttcacatggctcaactggaaacctgtttcatgaacaagcttactcaggaaccatctggtggtattccagcacattgttcttcagggggacgactctaagtcgctttgtggtggcagcagcttagaatcagtatttgtggttgggaaagatggacttacgggagcttggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacaggagagaggaatgaaaacacacccacgccttggaaccgtcctttggtaaagggaagctgtgggtccacattcccttcagcatcacctctagccctggcaactttcagcccctagctggcatcttgctcaccgccctgattctgttcctcggctccactgcttcaggtcacttcccatggctgcagtccactggtgggacaagagcaaagcccactgccagtaagaaggccaaagggcccttccatcctagccctctgcaggcatgcccttccttcccttgggcaggaaagccagcagccccagactgcccaaaaacttgcccaccagaccaagggcagtgccccaaggcccctgtctggaggaaatggcctagctatttgatgagaagaccaaaccccacatcctcctttcccctctctctagaatcatctcgcaccaccagttacacttgaattaagatctgcgctcaaatctcctcccacctctctccctgcttttgccttgctctgttcctctttggtcccaagagcagcagccgcagcctcctcgtgatcctccctagcataaatttcccaaacagtccacaggtcccatgcccactttgcgtctgcactgtgatcgtgacaaatcttccctcctcaccagctagtctggggtttcctctccctgccccaggccagaactgccttcttcatttccacccacgctcccagcctcttagctgaaagcacaaatggtgaaatcagtagtctcgctccatctctaatagactaaacctaaatgcctctaggacggactgttgctatccaagcgtttggtgttaccttctcctgggaggtcctgctgcaactcaagttccacaggatggtcaagctgtcagacatccaagtttacatcattgtaattattactggtatttacaatttgcaagagttttgggttagtttttttttttttttttgctttgtttttgtacaaaagagtctaacattttttgccaaacagatatatatttaatgaaaagaagagatacataaatgtgtgaatttccagtttttttttaattattttaatcccaaacatcttcctgaaaataacattcccttaaacatgctgtggaataaaatggattgtgatga

SEQ ID NO: 9542 - DNA, 3154 bp, Homo sapiens
ataaacgcaggtcacctgagccagtagcagcaacctgggtccccttccacgctgtggaatctttgtttttttttcactgctcgcaataaatcttgctgctgcttattatttgggtccgtgttacctttatgagctgtagcactcaccgcgaaggtttgcagcttcgctattcactcttgaagccagcgagaccacgaacccaccgggaggaagaaacaactccggacgcgccacctttaagagctgtaacactaacggtgaaagtctgcggtatcactcctgaagtcagggagaccacgaaccccccagaagaaactccggacgcatctgaacatctgaaggaacaaactctggacacaccatctttaagaactgaaacaccgcgacagttcgctgcttcattcttaaaggcagtgagaccgagaacgcaccaattctggacacaaaaggaccttagcaggctcaggaaatggcaagccatttatgaagagggaagagatagcaaacgttggtctcaagttctctagttctttacccagaccatagctggctgggggatgatcctgatttagtctggggggttcctttacgcattgccaccagcaggtgccgcaaatggaccattggcagtcttaaggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagctcagaacgcccagcagctccatgaacgaatccagtcctcgagtatggatgccaagctggaagccctgaaggacttggccagcctctcccgggatgtcacgtttgcccaggagtttataaacctggacggtatctctctcctcacgcagatggtggagagcggcactgagcgataccagaaattgcagaagatcatgaagccttgctttggagacatgctgtccttcaccctgacggccttcgttgagctgatggaccatggcatagtgtcctgggatacattttcggtggcgttcattaagaagatagcaagttttgtgaacaagtcagccatagacatctcgatcctgcagcggtccttggccattttggagtcgatggtgctcaatagccatgacctctaccagaaagtggcgcaggagatcaccatcggccagctcattccacacctgcaagggtcagatcaagaaatccaaacctatactattgcagtgattaatgcgcttttcctgaaggctcctgatgagaggaggcaggagatggcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattaatcatgtcaaccctgccatggacttcacgcagactccacctgggatgttggctctggacaacatgctgtactttgccaagcaccaccaagatgcctacatccggattgtgcttgagaacagtagtcgagaagacaagcatgaatgtccctttggccgcagtagtatagagctgaccaagatgctatgtgagatcttgaaagtgggcgagttgcctagtgagacctgcaacgacttccacccgatgttcttcacccacgacagatcctttgaggagtttttctgcatctgtatccagctcctgaacaagacatggaaggaaatgagggcaacttctgaagacttcaacaaggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactgaagtggccgggcccagacatgccccttccaaaactggaacacctagctaacaggagagaggaatgaaaacacacccacgccttggaaccgtcctttggtaaagggaagctgtgggtccacattcccttcagcatcacctctagccctggcaactttcagcccctagctggcatcttgctcaccgccctgattctgttcctcggctccactgcttcaggtcacttcccatggctgcagtccactggtgggacaagagcaaag

SEQ ID NO: 9543 - DNA, 858 bp, Homo sapiens
atagcagatctgaggcatgcatggtgtttgacatttctgtcttttaagtagggggacttcaaaaagtcgtgggcatccccctaggcaaagtgcagtgggcagggaccaggcagggtgcgggcgcaaggcgaacgcgcagaccacgagtgtcctggcgcaggtgccgggggcggcggctgcaactccgcagcgtccgctcgggaggagagttcgcggctgatctccggatgccttgcagatgcaaaatgtgtctctggccagcaggaggaaggaagaggaagtgagagcagcggcagccggcggtgcagcagccggccgacccagagtgtaagtgcgtgtgctggggcgagcgggagcgggcgaggatgggcacaggatagaggcagagccacccacgccgccgcggccccacgctgggcgacagagcctccagttccccttcaatggtggcgggtcgccggagctctgatcgccgggaacccttgccgctgctgtcctgcgaccccaagcagggggcagagcagggagcacttataccatacaaggcagagaagatacagatcaagatatgcccaaggcccttctagttcagcctctccttggagtaggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttc

SEQ ID NO: 9544 - DNA, 2621 bp, Homo sapiens
gagctcatcgaagtcatgctctgcacacatattatttatagcagatctgaggcatgcatggtgtttgacatttctgtcttttaagtagggggacttcaaaaagtcgtgggcatccccctaggcaaagtgcagtgggcagggaccaggcagggtgcgggcgcaaggcgaacgcgcagaccacgagtgtcctggcgcaggtgccgggggcggcggctgcaactccgcagcgtccgctcgggaggagagttcgcggctgatctccggatgccttgcagatgcaaaatgtgtctctggccagcaggaggaaggaagaggaagtgagagcagcggcagccggcggtgcagcagccggccgacccagagtgtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagctcagaacgcccagcagctccatgaacgaatccagtcctcgagtatggatgccaagctggaagccctgaaggacttggccagcctctcccgggatgtcacgtttgcccaggagtttataaacctggacggtatctctctcctcacgcagatggtggagagcggcactgagcgataccagaaattgcagaagatcatgaagccttgctttggagacatgctgtccttcaccctgacggccttcgttgagctgatggaccatggcatagtgtcctgggatacattttcggtggcgttcattaagaagatagcaagttttgtgaacaagtcagccatagacatctcgatcctgcagcggtccttggccattttggagtcgatggtgctcaatagccatgacctctaccagaaagtggcgcaggagatcaccatcggccagctcattccacacctgcaagggtcagatcaagaaatccaaacctatactattgcagtgattaatgcgcttttcctgaaggctcctgatgagaggaggcaggagatggcgaatattttggctcagaagcaactgcgttccatcattttaacacatgtcatccgagcccagcgggccatcaacaatgagatggcgcaccagctgtatgttctacaagtgctcacctttaacctcctggaagacaggatgatgaccaaaatggacccccaggaccaggctcagagggacatcatatttgaacttcgaagaattgcttttgatgctgagtctgaacctaacaacagcagtggcagcatggagaaacgcaagtccatgtacacgcgagattataagaagcttgggttcattaatcatgtcaaccctgccatggacttcacgcagactccacctgggatgttggctctggacaacatgctgtactttgccaagcaccaccaagatgcctacatccggattgtgcttgagaacagtagtcgagaagacaagcatgaatgtccctttggccgcagtagtatagagctgaccaagatgctatgtgagatcttgaaagtgggcgagttgcctagtgagacctgcaacgacttccacccgatgttcttcacccacgacagatcctttgaggagtttttctgcatctgtatccagctcctgaacaagacatggaaggaaatgagggcaacttctgaagacttcaacaaggtaatgcaggtggtgaaggagcaggttatgagagcacttacaaccaagcctagctccctggaccagttcaagagcaaactgcagaacctgagctacactgagatcctgaaaatccgccagtccgagaggatgaaccaggaagatttccagtcccgcccgattttggaactaaaggagaagattcagccagaaatcttagagctgatcaaacagcaacgcctgaaccgccttgtggaagggacctgctttaggaaactcaatgcccggcggaggcaagacaagttttggtattgtcggctttcgccaaatcacaaagtcctgcattacggagacttagaagagagtcctcagggagaagtgccccacgattccttgcaggacaaactgccggtggcagatatcaaagccgtggtgacgggaaaggactgccctcatatgaaagagaaaggtgcccttaaacaaaacaaggaggtgcttgaactcgctttctccatcttgtatgactcaaactgccaactgaacttcatcgctcctgacaagcatgagtactgtatctggacggatggactgaatgcgctactcgggaaggacatgatgagcgacctgacgcggaatgacctggacaccctgctcagcatggaaatcaagctccgcctcctggacctggaaaacatccagatccctgacgcacctccgccgattcccaaggagcccagcaactatgacttcgtctatgactgtaactga

SEQ ID NO: 9545 - DNA, 503 bp, Homo sapiens
agatgcaaaatgtgtctctggccagcaggaggaaggaagaggaagtgagagcagcggcagccggcggtgcagcagccggccgacccagagtggggcagagcagggagcacttataccatacaaggcagagaagatacagatcaagatatgcccaaggcccttctagttcagcctctccttggagtaggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctcca

SEQ ID NO: 9546 - DNA, 650 bp, Homo sapiens
gaccatgacttcctgggcaatctgtccttcctcagactgttgagtgccagacgtttatatgcatgtctggacagagagtgagcctggctcattcagaccctgggcaccattcagagcagaactcagtggtatagacacgtgtggccgtttacgctgtaggatcctcattcccactggctttgaacattttggggacttacaatgccgccacccgcggacatcgtcaaggtggccatagaatggccgggcgcctaccccaaactcatggaaattgatcagaaaaaaccactgtctgcaataataaaggaagtctgtgatgggtggtctcttgccaaccatgaatattttgcactccagcatgccgatagttcaaacttctatatcacagaaaagaaccgcaatgagataaaaaatggcactatccttcgattaaccacatctccagctcagaacgcccagcagctccatgaacgaatccagtcctcgagtatggatgccaagctggaagccctgaaggacttggccagcctctcccgggatgtcacgtttgcccaggagtttataaacctggacggtatctctctcctcacgcagatggtggagagcggcactgagcgataccagaaattgcagaagatcatgaagccttg

SEQ ID NO: 9547 - DNA, 3669 bp, Homo sapiens
gcgggcggaggctggaggagccgccgagcggagacccgggagcaggagctgggcctaggtctgcgccctggagggaggtgtagaaagaggtacatggagaacaagtttgtcaatccgtctgaacttcagttgccttacctgtaaggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgatggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccactcaccttttcctcctgagcctgctctctgatcagctggatccccacgtgagcaacagctggcccaggaaaggctgcctgcagaggacaggtgtgttgggcgtgttgagagccttgaagtgactacctgtatcttagatctgagtacaagcctgaggcttttgcttttgtcttttttgatgagggctcactccagcttcatatggtgccaagacgttgctgcttctgaggttggctctaacatctctggtctttagagccaccagatctctctggcccatacagatatcagagcagacggaaatttctccctgcaagcgctcagtctcatcccagcaagtcaaagacctcctggccaagtcctgccctcttaagtctccaggaacgctgcagggaaaacccagctgaggcctgggcctagactgtggtgaggtcactagattctactgctcttcccccacattaataccttttccttcctcagagagaaatctcccctaacctgaattgcagccccctccagtttgctttcctttggccttccagaccccaggaagttggccttcccttcctagtgctatggtttctgccattggccatgatttcagggagctggctgaggccggctgaggccacacctgtgccagtggggcttccctggtgctgcagcacttgtaaaccacacacacagcctctctccctggacatacgttagcacattggcattcagtattggtggcctggcatggtaggtactacccaatgaagagtgtactatatattttcattactataggccatacttatacagacgtgtatatatatttatataagatctacctatcttaggatggaaccttggggaaaaataaaattgaggggaagtaaaaagtatgtaacacttccagttgtgagccaagattgtaaccagagagcagccaggagcttcctgtcagtaaccatgttttcaataaatactctttcatgtacaaac

SEQ ID NO: 9548 - DNA, 2157 bp, Homo sapiens
atgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccatgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgatggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctga

SEQ ID NO: 9549 - DNA, 3678 bp, Homo sapiens
gtctgcgccctggagggaggtgtagaaagaggtacatggagaacaagtttgtcaatccgtctgaacttcagttgccttacctgtaaggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtaggttgaaatggacctcgttttcaacagtggcagctccgactgaaagagcactcctacaccttgaggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgatggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccactcaccttttcctcctgagcctgctctctgatcagctggatccccacgtgagcaacagctggcccaggaaaggctgcctgcagaggacaggtgtgttgggcgtgttgagagccttgaagtgactacctgtatcttagatctgagtacaagcctgaggcttttgcttttgtcttttttgatgagggctcactccagcttcatatggtgccaagacgttgctgcttctgaggttggctctaacatctctggtctttagagccaccagatctctctggcccatacagatatcagagcagacggaaatttctccctgcaagcgctcagtctcatcccagcaagtcaaagacctcctggccaagtcctgccctcttaagtctccaggaacgctgcagggaaaacccagctgaggcctgggcctagactgtggtgaggtcactagattctactgctcttcccccacattaataccttttccttcctcagagagaaatctcccctaacctgaattgcagccccctccagtttgctttcctttggccttccagaccccaggaagttggccttcccttcctagtgctatggtttctgccattggccatgatttcagggagctggctgaggccggctgaggccacacctgtgccagtggggcttccctggtgctgcagcacttgtaaaccacacacacagcctctctccctggacatacgttagcacattggcattcagtattggtggcctggcatggtaggtactacccaatgaagagtgtactatatattttcattactataggccatacttatacagacgtgtatatatatttatataagatctacctatcttaggatggaaccttggggaaaaataaaattgaggggaagtaaaaagtatgtaacacttccagttgtgagccaagattgtaaccagagagcagccaggagcttcctgtcagtaaccatgttttcaataaatactctttcatgtacaaa

SEQ ID NO: 9550 - DNA, 3574 bp, Homo sapiens
tcccaagaaggcggggcgggcggaggctggaggagccgccgagcggagacccgggagcaggagctgggcctaggtctgcgccctgaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgatggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccactcaccttttcctcctgagcctgctctctgatcagctggatccccacgtgagcaacagctggcccaggaaaggctgcctgcagaggacaggtgtgttgggcgtgttgagagccttgaagtgactacctgtatcttagatctgagtacaagcctgaggcttttgcttttgtcttttttgatgagggctcactccagcttcatatggtgccaagacgttgctgcttctgaggttggctctaacatctctggtctttagagccaccagatctctctggcccatacagatatcagagcagacggaaatttctccctgcaagcgctcagtctcatcccagcaagtcaaagacctcctggccaagtcctgccctcttaagtctccaggaacgctgcagggaaaacccagctgaggcctgggcctagactgtggtgaggtcactagattctactgctcttcccccacattaataccttttccttcctcagagagaaatctcccctaacctgaattgcagccccctccagtttgctttcctttggccttccagaccccaggaagttggccttcccttcctagtgctatggtttctgccattggccatgatttcagggagctggctgaggccggctgaggccacacctgtgccagtggggcttccctggtgctgcagcacttgtaaaccacacacacagcctctctccctggacatacgttagcacattggcattcagtattggtggcctggcatggtaggtactacccaatgaagagtgtactatatattttcattactataggccatacttatacagacgtgtatatatatttatataagatctacctatcttaggatggaaccttggggaaaaataaaattgaggggaagtaaaaagtatgtaacacttccagttgtgagccaagattgtaaccagagagcagccaggagcttcctgtcagtaaccatgttttcaataaatactctttcatgt

SEQ ID NO: 9551 - DNA, 1344 bp, Homo sapiens
gaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggtcagtgtctccgggctgctctgaggcccacgggaggagaccatcacacgacagcctttgacagctggctggcacctggagaatccctgagctggaaaagcagcttggtctgcagaactgagtcacaagactgaggcactggggagcctcagccccatctggttgttgctccctctgtgaccttgagcttgtcttccacttggtgccgtaggccctcatttgtccattgaagttagcacctgtccctcccgtcctccagagaggtcaggaggataagcattagaagactcactgtggtttattgagtgcttactgtgcaggtactgctgtagttttgtgaactgggaaggttaggagagaagagtggactggcatgatgtgcacaccctgggtacttaatcgatagttatccctcggtgctttcagtcctcactctatgcagagcactgttgtgccaggccctcaaaagctgatcatctaggggtcgagtgttttgaagttgatcatctcatcataaaaaatttggaaagtataaagaataaaaagttacctgtatttacacca

SEQ ID NO: 9552 - DNA, 2635 bp, Homo sapiens
gaaggcggggcgggcggaggctggaggagccgccgagcggagacccgggagcaggagctgggcctaggtctgcgccctggagggaggtgtagaaagaggtacatggagaacaagtttgtcaatccgtctgaacttcagttgccttacctgtaaggcagccgtgtctgtgtttttgtctcgcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggacaagcaccttaatcctctagacctgcctgtcactgatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgatggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcct

SEQ ID NO: 9553 - DNA, 2455 bp, Homo sapiens
ctttatgaccagccaacagaggaggaaggagcctgagcttggtatatggatcaggtgcccagttttgatggtaaatggacacgtacatccatcatggcctcatacatgagaggcatggtgaccaagaagggctcagatcgcttaggaatgaaggttggggtcacaccatcagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccaattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgatggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggca

SEQ ID NO: 9554 - DNA, 1168 bp, Homo sapiens
ggaggagccgccgagcggagacccgggagcaggagctgggcctaggtctgcgccctggagggaggtgtagaaagaggtacatggagaacaagtttgtcaatccgtctgaacttcagttgccttacctgtaagaattagagcccattgggaacgatgccaccaccgtcagacattgtcaaagtggccattgagtggccaggtgctaacgcccagctccttgaaatcgaccagaaacggcccctggcatccattatcaaggaagtttgtgatgggtggtcgttgccaaacccagagtattataccctccgttatgcagatggtcctcagctgtacatcaccgaacagactcgcagtgacattaagaatgggacaatcttacaactggctatctccccgtcccgggctgcacgccagctgatggagaggacccagtcatccaacatggagacccggctggatgccatgaaggagctggccaagctctctgccgacgtgactttcgctactgagttcatcaacatggatggcatcattgtgctgacaaggctcgtggaaagtggaaccaagctcttgtcccactacagtgagatgctggcattcaccctgactgccttcctagagctcatggaccatggcattgtctcctgggacatggtttcaatcacctttattaagcagattgcagggtatgtgagccagcccatggtggacgtgtcaatccttcagaggtccctggccatcctggagagcatggtcttgaacagccagagtctgtaccagaagatagccgaggaaatcaccgtgggacagctcatctcacacctccaggtctccaaccaggagattcagacctacgccattgcactgattaatgcactttttctgaaggctcctgaggacaaacgacaggatatggcaaatgcatttgcacagaagcatctccggtctataatcctgaatcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccg

SEQ ID NO: 9555 - DNA, 2158 bp, Homo sapiens
taccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaaacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgatggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcggaccacccagagtttcctcttggtccctgtctactaagagtcatgaaggcagggtgctctgcccactccatcaccatgaagcctgggattgggccacgaggaacaaacagcagatgcccttgccttccagtccaagaaactgcttcttgaaatggatttaacaacagccactcaccttttcctcctgagcctgctctctgatcagctggatccccacgtgagcaacagctggcccaggaaaggctgcctgcagaggacaggtgtgttgggcgtgttgagagccttgaagtgactacctgtatcttagatctgagtacaagcctgaggcttttgcttttgtcttttttgatgagggctcactccagcttcatatggtgccaagacgttgctgcttctgaggttggctctaacatctctggtctttagagccaccagatctctctggcccatacagatatcagagcagacggaaatttctccctgcaagcgctcagtctcatcccagcaagtcaaagacctcctggccaagtcctgccctcttaagtctccaggaacgctgcagggaaaacccagctgaggcctgggcctagactgtggtgaggtcactagattctactgctcttcccccacattaataccttttccttcctcagagagaaatctcccctaacctgaattgcagccccctccagtttgctttcctttggccttccagaccccaggaagttggccttcccttcctagtgctatggtttctgccattggccatgatttcagggagctggctgaggccggctgaggccacacctgtgccagtggggcttccctggtgctgcagcacttgtaaaccacacacacagcctctctccctggacatacgttagcacattggcattcagtattggtggcctggcatggtaggtactacccaatgaagagtgtactatatattttcattactataggccatacttatacagacgtgtatatatatttatataagatctacctatcttaggatggaaccttggggaaaaataaaattgaggggaagtaaaaagtatgtaacacttccagttgtgagccaagattgtaaccagagagcagccaggagcttcctgtcagtaaccatgttttcaataaatactctttcatgta

SEQ ID NO: 9556 - DNA, 1741 bp, Homo sapiens
aagcacttaaaatgtggctggtgcaactaaggaaccaaattttcaacttaaatttgttttaactgatttaaatgcaaatagctgcatatggctagtggctgctatactggacagcacagccctagagacagagctactgagtagggaaattgaaggacatagtggtggtacatgtggaaaatggaggagagcctcatttgggcaagaaagaaccaagagggacaggattcataatgcatgtgatccgagggaaccgccccatcaaaactgagatggcccatcagctatatgtccttcaagtcctaacctttaaccttctggaagaaaggatgatgaccaagatggaccccaatgaccaggctcaaagggacatcatatttgaactgaggaggattgcatttgacgcagagtctgatcctagcaatgcccctgggagtgggaccgaaaaacgcaaagccatgtacacaaaggactacaaaatgctgggatttaccaaccacatcaatccagccatggactttacccagactcctcctggaatgctggccttggacaacatgctgtacttggctaaagtccaccaggacacctacatccggattgtcttggagaacagtagccgggaagacaaacatgaatgcccctttggccgcagtgccattgagctcaccaaaatgctctgtgaaatcctgcaggttggggaactaccaaatgaaggacgcaatgactaccacccgatgttctttacccatgaccgagcctttgaagagctctttggaatctgcatccagctgttgaacaagacctggaaggagatgagggcaacagcagaggacttcaacaaggttatgcaagtcgtccgagagcaaatcactcgagctttgccctccaaacccaactctttggatcagttcaagagcaaattgcgtagcctgagttactctgagattctacgactgcgccagtctgagaggatgagtcaggatgacttccagtccccgccaattgtggagctgagggagaagatccagcccgagatccttgagctgatcaagcagcagcgcctgaaccggctctgtgagggcagcagcttccgaaagattgggaaccgccgaaggcaagaacggttctggtactgccggttggcactgaaccacaaggtccttcactatggtgacttggatgacaacccacaaggggaggtgacatttgaatccctgcaggagaaaattcctgttgcagacattaaggccattgtcactgggaaagattgtccccacatgaaagagaaaagtgctctgaaacagaacaaggaggtgttggaattggccttctccatcctgtatgaccctgatgagaccttaaacttcatcgcacctaataaatatgagtactgcatctggattgatggcctcagtgcccttctggggaaggacatgtccagtgagctgaccaagagtgacctggacaccctgctgagcatggagatgaagctgcggctcctggacctggagaacatccagattcccgaagccccaccccccatccccaaggagcccagcagctatgactttgtctatcactatggctgagcctggagccagaaacgacggtacccaggagaagggattttgggcccaggagaaacacttacattctggtgccttgtcttttgcttgtacagaatctgtagtgattttggtggccagtaaatgccagccatttctcaaacccacctcgg

SEQ ID NO: 9557 - DNA, 2531 bp, Homo sapiens
ctacccccagactccaacccggaactaacctcggctcccttgggaaggccgcgttgcatggccaggagcagcagtctgggccgcgagtgcgggacaccgaggtcaggtctcggaaagggaggacctcctcgtccccaggggccccaggccaggtgcacccttggccgcaggtgcacggtctccggaaagtgcaggcgcccacgtcccagctggaccatggcgcctccgcggaacgtggtgaagattgccatcaagatgcgtgacgccatcccgcagctcatccagctggaccaggcgaagcccctggccgctgtgctgaaggaggtgtgcgacgcgtggagcctgacgcactctgagcgttacgccctgcagtttgcggatgggcaccggagatacatcaccgagaataaccgcgcggagatcaagaatggcagcatcctgtgcctcagcacggccccagaccttgaggctgagcagctcttgggtgggctgcagagtaacagtcctgaagggcgccgggaagccctgaggcgccttgttccgctggcctcggacatgatctttgccagggaggtcatcagccgtaatgggctccagatactaggcaccatcattgaagatggggacgacctaggagaggtgctggccctcagcctgagggccttctcagagctcatggagcacggcgtggtgtcctgggagactctgagcatcccctttgtgaggaaggtggtgtgctacgtgaacatgaacctcatggatgcctccgtgcctcccctggcccttgggctgctggagagtgtgaccttgagcagcccagccctgggccagctggtcaagagcgaggtgcccctggataggctgctggtgcacctacaggtgatgaaccagcagctgcaaaccaaggccatggccctgctgacagccttgctgcagggggccagccctgtggaacgcaagcacatgcttgactatctttggcagaggaaccttcgccagttcatctataagaacatcatccacagtgcagcaccaatgggcgacgagatggctcatcacctgtacgtactgcaggctctcatgctggggctgctggagccgcgcatgcggacgcccctggacccctacagccaggagcagcgggagcagctgcaggtcctacgccaggctgccttcgaggtggagggggagtcctcgggtgccgggctaagtgctgaccgtcgccgttccctctgtgcccgagagttccgcaaactgggcttttctaacagcaacccagcacaggacctggagcgcgtgccccccggtctgctggccctggacaacatgttgtacttctccagaaacgcgcccagcgcgtacagccggtttgtgttggagaacagcagccgcgaggacaagcacgagtgcccctttgcccggggcagcatccagctgacggtgctgctgtgtgagctgctccgtgttggggagccctgctctgagacagcccaggacttctcacccatgttcttcggccaagaccagagcttccacgagctcttctgtgtgggcatccagctgttgaataagacctggaaggagatgcgggctacacaggaggacttcgacaaggtcatgcaggtggtgcgggagcagctggcccgcactctggccctgaagcccacttccctggagctcttccgaaccaaggtgaatgcgctcacttatggggaggtgctgcggctgcggcagactgaacggctgcaccaggagggcacactggctccccctatactggagctgcgggagaagctgaagccagagctcatgggcctgatccgccagcagcgcttgctccgcctctgtgaggggacgctcttccgcaagatcagcagccggcggcgccaggataagctgtggttctgctgcctgtcccccaaccacaagctgctgcagtacggagacatggaggagggcgccagcccgcctaccctggagagtctgcccgagcaactccctgtggccgacatgagggcactcctgacaggcaaggactgcccccatgtccgggagaagggctccgggaagcagaacaaggacctctatgagttggccttctcaatcagctatgaccgtggggaggaggaagcgtacctcaacttcattgccccctccaagcgggagttctacctgtggacagatgggctcagtgccttgctgggcagtcccatgggcagcgagcagacacggctggacctggagcagctgctgaccatggagaccaagctgcgtctgctggagctggagaacgtgcccatccccgagcggccaccccctgtgcccccaccccccaccaacttcaacttctgctatgactgcagcatcgctgaaccttgacagtgtggctggccatgggccacagctgcggccactgcagcagccatgaagggcagtgggtagaggagtgcaggcaccctgaccagcagagattgctgcagaaataaagtctgcttggctcttgggatatgttgagccagctctgtaccttg

SEQ ID NO: 9558 - DNA, 2913 bp, Homo sapiens
gaatggctggggttggctgaagagcgcacagtggagttttaatgtccgccatgttggccatggcgtattgaagagagcgagcgagagaggagcggagcggcacagcctcccaccctcccggctggtgttagtgcccggacggcgggctctgcgctccgcccctcaagtccccggcagcggttggcgagtggggaccgaacccccggttctccatgatcccgctggccggggccgtttccccagagcggagaggtatctgctgcgcctgagatgagtaaactgtcgtttcgggcgcgggcgctagacgcctcgaagccgctgccggttttccgctgtgaggatctgcccgacctgcacgaatacgcctcgataaacagggccgtgccgcagatgcccaccggaatggagaaggaagaggagtcggaacatcatcttcagcgggctatttcagcacagcaggtgtatggcgagaagagggataatatggttataccggtcccagaggcagaaagtaatattgcttactatgagtctatatatcctggggaatttaagatgccaaagcagctcattcacatacagccttttagtttggatgctgaacagcctgattatgatttggattctgaagatgaagtatttgtgaataaactgaaaaagaaaatggacatctgcccattgcaatttgaggagatgattgaccgcctagaaaaaggcagtggtcagcagccagtcagtctgcaggaagccaaactactgctaaaagaagatgatgaactaattagagaagtttatgaatattggattaaaaagagaaaaaactgtcgagggccatctcttattccatcagtaaaacaagagaagcgagatggttccagcacaaatgatccttatgtggcttttagaaggcgtactgaaaaaatgcagactcgaaaaaatcgcaaaaatgatgaagcctcttacgaaaaaatgcttaagctgcgacgagatctaagtcgagctgttactattctagagatgataaaaagaagagaaaaaagtaaaagagagctattgcacttaacactggaaattatggaaaagaggtataatttgggcgactacaatggagagatcatgtctgaggttatggcacagagacagccaatgaaacctacttatgccatccccatcatccctattactaatagcagtcaatttaaacaccaggaagcaatggatgtgaaggagttcaaagttaataagcaagataaagccgatcttatccgaccgaaacggaaatatgaaaagaagcccaaagtcttaccatcgtctgccgctgctactccccaacagacgagtcctgctgcactgccagtcttcaatgctaaagatctgaatcagtatgactttcccagctcagacgaagaacctctctcccaggttttgtctggctcttcggaagctgaggaagacaatgatcctgatggtccttttgctttccgtaggaaagcaggctgtcagtactatgctcctcacttagaccaaactggcaactggccttggactagtcctaaagatggaggattaggggatgtgcgatatagatactgcttaactactctcaccgtaccccaaaggtgtattggatttgcacgaagacgggttgggcgcggtggaagggtcttactggacagagctcattcagactatgacagtgtgtttcaccatctggatttggaaatgctttcctcaccacaacattctccagtcaatcagtttgccaatacctcagaaacaaatacctcggacaaatctttctctaaagacctcagtcagatactagtcaatatcaaatcatgtagatggcggcattttaggcctcggacaccatccctacatgacagtgacaatgatgaactctcctgtagaaaattatataggagtataaaccgaacaggaacagcacaacctgggacccagacatgcagtacctctacgcaaagtaaaagtagcagtggttcagcacactttgcatttacagccgaacaataccagcaacatcaacagcaactggcactcatgcagaaacagcagcttgcacaaattcagcaacagcaagcaaatagtaattcctccaccaacacatcacagaaccttgcatctaaccagcagaaaagtggctttcgcctgaatatacagggtttagaaagaacactacagggttttgtttctaagactttggattctgctagtgcacagtttgctgcttctgctttggtgacatcagaacaactgatgggattcaagatgaaggatgatgtggtgcttggaatcggggtgaatggcgtccttccagcctcaggagtatacaagggcttacacctcagtagtactacaccaacagcacttgtacatacaagtccatcaacggcaggttcagctttgttacagccttcaaatattacacagacttcaagttcccacagtgcactgagtcatcaagtaactgctgccaattctgcaacaactcaggttctgattgggaacaacattcgattaactgtaccttcatcagttgccactgtaaactctattgccccaataaatgcacgacatatacctaggactttaagtgctgttccatcatctgccttaaagctggccgctgcagcaaactgtcaagtttccaaggtcccatcttcatcctctgtagattcagttccaagggaaaatcatgaatcagaaaagccagcactgaacaacatagcagacaacacagtagcgatggaggtgacgtagcttcctccgagtggaactgcagcctggggacttgattaggtgctatgcatcagtagcattttgaatgcaagggatgatggaaagcagcacatgcgtttctgtggcagctgtggggacttgacagcaatgctc

SEQ ID NO: 9559 - DNA, 4057 bp, Homo sapiens
gcgtgcccgcgccgctgcgcgatgcagtgtggggaatggctggggttggctgaagagcgcacagtggagttttaatgtccgccatgttggccatggcgtattgaagagagcgagcgagagaggagcggagcggcacagcctcccaccctcccggctggtgttagtgcccggacggcgggctctgcgctccgcccctcaagtccccggcagcggttggcgagtggggaccgaacccccggttctccatgatcccgctggccggggccgtttccccagagcggagaggtatctgctgcgcctgagatgagtaaactgtcgtttcgggcgcgggcgctagacgcctcgaagccgctgccggttttccgctgtgaggatctgcccgacctgcacgaatacgcctcgataaacagggccgtgccgcagatgcccaccggaatggagaaggaagaggagtcggaacatcatcttcagcgggctatttcagcacagcaggtgtatggcgagaagagggataatatggttataccggtcccagaggcagaaagtaatattgcttactatgagtctatatatcctggggaatttaagatgccaaagcagctcattcacatacagccttttagtttggatgctgaacagcctgattatgatttggattctgaagatgaagtatttgtgaataaactgaaaaagaaaatggacatctgcccattgcaatttgaggagatgattgaccgcctagaaaaaggcagtggtcagcagccagtcagtctgcaggaagccaaactactgctaaaagaagatgatgaactaattagagaagtttatgaatattggattaaaaagagaaaaaactgtcgagggccatctcttattccatcagtaaaacaagagaagcgagatggttccagcacaaatgatccttatgtggcttttagaaggcgtactgaaaaaatgcagactcgaaaaaatcgcaaaaatgatgaagcctcttacgaaaaaatgcttaagctgcgacgagatctaagtcgagctgttactattctagagatgataaaaagaagagaaaaaagtaaaagagagctattgcacttaacactggaaattatggaaaagaggtataatttgggcgactacaatggagagatcatgtctgaggttatggcacagagacagccaatgaaacctacttatgccatccccatcatccctattactaatagcagtcaatttaaacaccaggaagcaatggatgtgaaggagttcaaagttaataagcaagataaagccgatcttatccgaccgaaacggaaatatgaaaagaagcccaaagtcttaccatcgtctgccgctgctactccccaacagacgagtcctgctgcactgccagtcttcaatgctaaagatctgaatcagtatgactttcccagctcagacgaagaacctctctcccaggttttgtctggctcttcggaagctgaggaagacaatgatcctgatggtccttttgctttccgtaggaaagcaggctgtcagtactatgctcctcacttagaccaaactggcaactggccttggactagtcctaaagatggaggattaggggatgtgcgatatagatactgcttaactactctcaccgtaccccaaaggtgtattggatttgcacgaagacgggttgggcgcggtggaagggtcttactggacagagctcattcagactatgacagtgtgtttcaccatctggatttggaaatgctttcctcaccacaacattctccagtcaatcagtttgccaatacctcagaaacaaatacctcggacaaatctttctctaaagacctcagtcagatactagtcaatatcaaatcatgtagatggcggcattttaggcctcggacaccatccctacatgacagtgacaatgatgaactctcctgtagaaaattatataggagtataaaccgaacaggaacagcacaacctgggacccagacatgcagtacctctacgcaaagtaaaagtagcagtggttcagcacactttgcatttacagccgaacaataccagcaacatcaacagcaactggcactcatgcagaaacagcagcttgcacaaattcagcaacagcaagcaaatagtaattcctccaccaacacatcacagggttttgtttctaagactttggattctgctagtgcacagtttgctgcttctgctttggtgacatcagaacaactgatgggattcaagatgaaggatgatgtggtgcttggaatcggggtgaatggcgtccttccagcctcaggagtatacaagggcttacacctcagtagtactacaccaacagcacttgtacatacaagtccatcaacggcaggttcagctttgttacagccttcaaatattacacagacttcaagttcccacagtgcactgagtcatcaagtaactgctgccaattctgcaacaactcaggttctgattgggaacaacattcgattaactgtaccttcatcagttgccactgtaaactctattgccccaataaatgcacgacatatacctaggactttaagtgctgttccatcatctgccttaaagctggccgctgcagcaaactgtcaagtttccaaggtcccatcttcatcctctgtagattcagttccaagggaaaatcatgaatcagaaaagccagcactgaacaacatagcagacaacacagtagcgatggaggtgacgtagcttcctccgagtggaactgcagcctggggacttgattaggtgctatgcatcagtagcattttgaatgcaagggatgatggaaagcagcacatgcgtttctgtggcagctgtggggacttgacagcaatgctcatctctcatgcttcaatttttcttttcttactgttaataggaaaaaaatcaacatctgtaaattaagaatacagcaattatctgtacagtactgcatatttgtaatacccttgtatatatgttacttgaatacagaaatgttcatttgtgatgctttgcacttgggggtggggggtgggagggaaatcaattgcaacaaagagtgtgagatgtgagattgtatagagatgaagtgtcatcacatcatgtgcatggtgcggaacctgctgttttatctatttattgtgccgtgtttacagttttttgtacactgtaccttcattggttcctgtgctgtagtaaatgtgttaggtagctgtggactccttggtattttgtaaatggtataacataacttggttcccctctgggtccttgagttttctgtgtatcatgtgaaaaaaaatggtgacatacatacagaattttacaaaaaaaaaaaaaaaaaaaaaggcatcagtttttttaaaaatggggaatgtactattaaatggggatcttcctggtctactatcattaggacaagtaacaagctaaaaatgaagtctcttgaatctttccatccccaacttgcccacaaagctgtgggtggtttctggtacttaaagcactaatattatgttgctgctctgcgaacagcccagtagtcccatttccttccacaccaaaaagtgttaaatcaagtatgcaaatggagtccttacaactggagtttatgttgtcttgccctttttttagcacaaaaaaaattgtacttttttattgtcgaattgtttaaaagacttcattctttacttgttcttacgaaaaggatataagggagaagaatgcagtaattgctgtacgtgtatcatcattccagtttctaaaaacagccagccagcttttttccttttaagattctccagaaggctgcaaggccagaaccacaaatatcgggtgccttcctttggaaatatttgacctctcttctgtgaagagaatggtacttaacagactactactagtgctttgtcagtaccgaagtctgaatgcccagtccaatggcatacattatccttaaggtttttaatcccacctggaaaaattgtgatagaattctcacaaaataaacccagggcattacatgttgacaaactaa

SEQ ID NO: 9560 - DNA, 3909 bp, Homo sapiens
agcgctcgcctgcttgccatcgcaaagttgttaaccccagagtcttctggctgtgctgcctcctctgcttttaatcttctgtggatatttctccgatttcccccaaaagcccacagatcctgggggaagccaccccattcggccaccgatcatggaagaaagtattactttttatttaccaaacattttaaagatgttggaagatccatatgctgcctggaggctgttgtttctagggacacaagtatccagcctatattgttacaattttttttcaagaactgccgtcttctttgcctgcactaatggaacatcatcttcagcgggctatttcagcacagcaggtgtatggcgagaagagggataatatggttataccggtcccagaggcagaaagtaatattgcttactatgagtctatatatcctggggaatttaagatgccaaagcagctcattcacatacagccttttagtttggatgctgaacagcctgattatgatttggattctgaagatgaagtatttgtgaataaactgaaaaagaaaatggacatctgcccattgcaatttgaggagatgattgaccgcctagaaaaaggcagtggtcagcagccagtcagtctgcaggaagccaaactactgctaaaagaagatgatgaactaattagagaagtttatgaatattggattaaaaagagaaaaaactgtcgagggccatctcttattccatcagtaaaacaagagaagcgagatggttccagcacaaatgatccttatgtggcttttagaaggcgtactgaaaaaatgcagactcgaaaaaatcgcaaaaatgatgaagcctcttacgaaaaaatgcttaagctgcgacgagatctaagtcgagctgttactattctagagatgataaaaagaagagaaaaaagtaaaagagagctattgcacttaacactggaaattatggaaaagaggtataatttgggcgactacaatggagagatcatgtctgaggttatggcacagagacagccaatgaaacctacttatgccatccccatcatccctattactaatagcagtcaatttaaacaccaggaagcaatggatgtgaaggagttcaaagttaataagcaagataaagccgatcttatccgaccgaaacggaaatatgaaaagaagcccaaagtcttaccatcgtctgccgctgctactccccaacagacgagtcctgctgcactgccagtcttcaatgctaaagatctgaatcagtatgactttcccagctcagacgaagaacctctctcccaggttttgtctggctcttcggaagctgaggaagacaatgatcctgatggtccttttgctttccgtaggaaagcaggctgtcagtactatgctcctcacttagaccaaactggcaactggccttggactagtcctaaagatggaggattaggggatgtgcgatatagatactgcttaactactctcaccgtaccccaaaggtgtattggatttgcacgaagacgggttgggcgcggtggaagggtcttactggacagagctcattcagactatgacagtgtgtttcaccatctggatttggaaatgctttcctcaccacaacattctccagtcaatcagtttgccaatacctcagaaacaaatacctcggacaaatctttctctaaagacctcagtcagatactagtcaatatcaaatcatgtagatggcggcattttaggcctcggacaccatccctacatgacagtgacaatgatgaactctcctgtagaaaattatataggagtataaaccgaacaggaacagcacaacctgggacccagacatgcagtacctctacgcaaagtaaaagtagcagtggttcagcacactttgcatttacagccgaacaataccagcaacatcaacagcaactggcactcatgcagaaacagcagcttgcacaaattcagcaacagcaagcaaatagtaattcctccaccaacacatcacagggttttgtttctaagactttggattctgctagtgcacagtttgctgcttctgctttggtgacatcagaacaactgatgggattcaagatgaaggatgatgtggtgcttggaatcggggtgaatggcgtccttccagcctcaggagtatacaagggcttacacctcagtagtactacaccaacagcacttgtacatacaagtccatcaacggcaggttcagctttgttacagccttcaaatattacacagacttcaagttcccacagtgcactgagtcatcaagtaactgctgccaattctgcaacaactcaggttctgattgggaacaacattcgattaactgtaccttcatcagttgccactgtaaactctattgccccaataaatgcacgacatatacctaggactttaagtgctgttccatcatctgccttaaagctggccgctgcagcaaactgtcaagtttccaaggtcccatcttcatcctctgtagattcagttccaagggaaaatcatgaatcagaaaagccagcactgaacaacatagcagacaacacagtagcgatggaggtgacgtagcttcctccgagtggaactgcagcctggggacttgattaggtgctatgcatcagtagcattttgaatgcaagggatgatggaaagcagcacatgcgtttctgtggcagctgtggggacttgacagcaatgctcatctctcatgcttcaatttttcttttcttactgttaataggaaaaaaatcaacatctgtaaattaagaatacagcaattatctgtacagtactgcatatttgtaatacccttgtatatatgttacttgaatacagaaatgttcatttgtgatgctttgcacttgggggtggggggtgggagggaaatcaattgcaacaaagagtgtgagatgtgagattgtatagagatgaagtgtcatcacatcatgtgcatggtgcggaacctgctgttttatctatttattgtgccgtgtttacagttttttgtacactgtaccttcattggttcctgtgctgtagtaaatgtgttaggtagctgtggactccttggtattttgtaaatggtataacataacttggttcccctctgggtccttgagttttctgtgtatcatgtgaaaaaaaatggtgacatacatacagaattttacaaaaaaaaaaaaaaaaaaaaaggcatcagtttttttaaaaatggggaatgtactattaaatggggatcttcctggtctactatcattaggacaagtaacaagctaaaaatgaagtctcttgaatctttccatccccaacttgcccacaaagctgtgggtggtttctggtacttaaagcactaatattatgttgctgctctgcgaacagcccagtagtcccatttccttccacaccaaaaagtgttaaatcaagtatgcaaatggagtccttacaactggagtttatgttgtcttgccctttttttagcacaaaaaaaattgtacttttttattgtcgaattgtttaaaagacttcattctttacttgttcttacgaaaaggatataagggagaagaatgcagtaattgctgtacgtgtatcatcattccagtttctaaaaacagccagccagcttttttccttttaagattctccagaaggctgcaaggccagaaccacaaatatcgggtgccttcctttggaaatatttgacctctcttctgtgaagagaatggtacttaacagactactactagtgctttgtcagtaccgaagtctgaatgcccagtccaatggcatacattatccttaaggtttttaatcccacctggaaaaattgtgatagaattctcacaaaataaacccagggcattacatgttgacaaactaa

SEQ ID NO: 9561 - DNA, 3642 bp, Homo sapiens
gccgcccgggctgttcctgtaaggcggggagacaatgagtaaactctccttccgagcgcgggcgctggacgccgccaagccgctgcctatctaccgcggcaaggacatgcctgatctcaacgactgcgtctccatcaaccgggccgtgccccagatgcccaccgggatggagaaggaggaggaatcggaacatcatttacagcgagcaatttcagcacagcaagtgtttagagaaaaaaaagagagtatggtcattcctgttcctgaggcagagagcaacgtcaactattacaatcgcttgtacaaaggagagtttaaacagccaaaacagttcattcatattcagccttttaatctagacaacgagcaaccagattatgatatggattcagaagatgagactttattaaatagacttaacagaaagatggaaattaagcctttgcaatttgaaattatgattgacagacttgaaaaagccagttctaatcagcttgtaacacttcaagaagcaaaactgctgctaaacgaagatgattaccttattaaagctgtatatgactactgggtgagaaaacgtaaaaactgcagggggccatccctcattcctcagataaaacaagagaaaagagatggctctaccaacaatgacccttatgttgcctttcggagaagaacagagaaaatgcaaactcgaaagaatcgtaagaatgatgaagcctcttatgaaaagatgttgaaactgagacgagaatttagtagagccataacaattttggaaatgattaagagaagagagaaaacaaaacgagaattattgcacttaaccttagaagttgtggagaaaagataccatttgggagactatggtggtgaaatccttaatgaagtaaaaatcagtagatcagaaaaagagttatatgccactccagcaactcttcataatggaaatcatcacaaagttcaagaatgtaaaactaagcaccctcatcatttgtctttgaaagaagaggcttctgatgtggttcgtcaaaagaagaagtacccaaagaagcctaaagcagaggctttgataacatctcagcaacccactcctgagacattgcctgtgatcaataagagtgacattaagcaatatgattttcacagctcagatgaagatgaatttccacaggtattgtccccagtatcagaaccggaagaagaaaatgatcctgatggtccctgtgctttcagaaggcgggcaggatgccagtattatgctcctcgtttggaccaagctaaccattcatgtgaaaattcagaattggcagatttggataagttgaggtataggcattgccttacaacacttacagtcccaagaagatgtataggatttgcaaggaggcgaattggcagaggtggaagggtcataatggaccgaatatccacagaacatgacccagtcctgaaacagatagaccctgaaatgctgaatagtttttcaagctcttcccaaactatagacttttcttctaatttctctcggaccaatgcttccagtaaacattgtgaaaatagactgtctctttctgaaatattaagcaatatcagatcatgtcgactacagtgtttccagccaaggctactaaatttacaggacagtgatagtgaagaatgtacctcaagaaaaccagggcagactgtgaacaataaaagagtttctgcagcatctgtagctttattgaacaccagcaagaatggcatatcagtaacagggggtatcacagaagagcagtttcagacacatcagcagcagttagttcagatgcaaaggcagcaacttgcccagcttcagcagaaacagcaatctcagcattcctcgcaacagacacatccaaaagcacagggctcaagcacctctgactgtatgtctaaaacacttgactcagccagcgcccactttgctgcatctgcagtggtcagtgcacctgttccaagtcgcagtgaggtagccaaggaacagaacactggccacaacaacataaacggtgttgtccagccttcaggaacctctaaaacattatactccaccaatatggctttatcatccagcccagggatttcagctgtacagcttgtaaggacagttggccacaccactacaaaccacttaatcccagcattgtgcacaagcagtcctcagacacttcccatgaacaattcctgcctgacaaatgcagtgcacctcaataatgtcagtgttgtttctccagtcaatgtgcatatcaatacacggacttcagcaccatcgccaacagccttaaaacttgccacagttgctgccagtatggacagagtgccaaaggttactcccagcagtgccatcagcagcatagcaagagagaaccacgaaccagaaagattgggcttaaatggaatagcagagacaacagtagctatggaagtgacataacctaaaacacgtggctctgacctgtgctgatggtgtgcagtcattcatattccagctgaatgcaaaaggcaacactctgtggatcacagagtgtaacaatggacctaaatggactatagtatattggatgttaaatccatatatgatgtatattttgtaaaattgggaaaatcactaccttgtaaaatagtttatttgtatcatcaatattatttctgttacttgaatagtagatattcatcatcatgcttttgcacttgaatttgcaactgaatggattttaaaaaataattctttaatgggatcatgagcatgaaatgggatcctgcatcacttgttttaactatttattttgccatgtttacattttgtatcttgtaaaaataaatccaactttgtgtctaaaaagttaaagattcatagctaggaaatgaaattcttgtaatttttttctaaaggaactgtaaagttttcacttggttcattttgtttcacaatttgactagatggactttttggtaaatactttagtggcatttcactgtcaaatatgaagttcaaggcaaaatagtattttctattactgtgcaggggaaagggatggatcgatacatgcaaatttaatgtagtaactcacttttccatatattttgaatgtatatttctatttatgataccaatttataaaaaataattacacagaaaaaatggaataggaaaaattatgcatctagcacatttaaactgtgcaaatatgaaaatttttcgaggattacattttatctgaaggctgcatattttaactggctttaaaactgtaacacatcacataaaagatactttaccaggtatgtattgcattatatcattgcaataattattggaagtctagatatcgagccatcccaggtgttgggcggggggagggttgtggcaagattgtcttttcaattttggagagttttcctgtggctacaaggcaagtaacgggttggaaaaagtctgactgtaagcgttggacaccttcatagtgtagtgttttagtgactttttttatacggttcttgtaaattagatacgtgtagtggtgtttcagaatgtttgtttatgcactagttcagacaactttccctgttacttgttcttgataagtgaaaactgcagggaaataaaaaatacatatc

SEQ ID NO: 9562 - DNA, 1116 bp, Homo sapiens
cgacctccggcccaggatacttacgttgccgccatttttgagtagggctaatgaaagatgtctgatgtcactgtctataccggtgatcacttgagccgtatgtttaataacgaaagtacggaagacagcgtcttgaaaaaaaataattcttcctaaagcttggaaactttcccttacctttttgcctttatcgaagatggctgaaacagagtcagtagctgctctagctgccggaagtgactgtgcctctatgatccaaaaggctcttttgcgttgcactttcgacgacttccggcggctcctctcgcgaggattggctgttagcggcgttgtagttaagctcgtgtaacggcggcggtgtcggcagctgctgtagcgaagagagtttggcgcgatgtctcacaccattttgctggtacagcctaccaagaggccagaaggcagaacttatgctgactacgaatctgtgaatgaatgcatggaaggtgtttgtaaaatgtatgaagaacatctgaaaagaatgaatcccaacagtccctctatcacatatgacatcagtcagttgtttgatttcatcgatgatctggcagacctcagctgcctggtttaccgagctgatacccagacataccagccttataacaaagactggattaaagagaagatctacgtgctccttcgtcggcaggcccaacaggctgggaaataattgtgttggaagcactgggggggttggggtgggcttggaacacaggtgtgtacagcgtgctgtagtggaagttttgtatcatagtaatcctgtttccactttgttatactctagccaagattgactgtattagatgaaatgtgaggatcttgttcaatcggaaacccccgttacctcctctttttctttctctttctttttttttttttacttaaacatttttatgatgatttagatggaagttgttcttcgtcacttaatgttggttccagtccttcaactgttcatatctactttataacattcacatactaacccttcttcaagatggggtggggggtggaaatgcagtttagccatgtcctcaagataaagtcttggtaaaaataaataaatgtcctttagtt

SEQ ID NO: 9563 - DNA, 4645 bp, Homo sapiens
gcgcatgcgtcctagcagcgggacccgcggctcgggatggaggctggacacctgttctgctgttgtgtcctgccattctcctgaagaacagaggcacactgtaaaacccaacacttccccttgcattctataagattacagcaagatggaaataccaaatccccctacctccaaatgtatcacttactggaaaagaaaagtgaaatctgaatacatgcgacttcgacaacttaaacggcttcaggcaaatatgggtgcaaaggctttgtatgtggcaaattttgcaaaggttcaagaaaaaacccagatcctcaatgaagaatggaagaagcttcgtgtccaacctgttcagtcaatgaagcctgtgagtggacacccttttctcaaaaagtgtaccatagagagcattttcccgggatttgcaagccaacatatgttaatgaggtcactgaacacagttgcattggttcccatcatgtattcctggtcccctctccaacagaactttatggtagaagatgagacggttttgtgcaatattccctacatgggagatgaagtgaaagaagaagatgagacttttattgaggagctgatcaataactatgatgggaaagtccatggtgaagaagagatgatccctggatccgttctgattagtgatgctgtttttctggagttggtcgatgccctgaatcagtactcagatgaggaggaggaagggcacaatgacacctcagatggaaagcaggatgacagcaaagaagatctgccagtaacaagaaagagaaagcgacatgctattgaaggcaacaaaaagagttccaagaaacagttcccaaatgacatgatcttcagtgcaattgcctcaatgttccctgagaatggtgtcccagatgacatgaaggagaggtatcgagaactaacagagatgtcagaccccaatgcacttccccctcagtgcacacccaacatcgatggccccaatgccaagtctgtgcagcgggagcaatctctgcactccttccacacacttttttgccggcgctgctttaaatacgactgcttccttcacccttttcatgccacccctaatgtatataaacgcaagaataaagaaatcaagattgaaccagaaccatgtggcacagactgcttccttttgctggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcagaggctaactctcgctgtcagactcccacaaaacagaaggctagtccagccccacctcaactctgcgtagtggaagcaccctcggagcctgtggaatggactggggctgaagaatctctttttcgagtcttccatggcacctacttcaacaacttctgttcaatagccaggcttctggggaccaagacgtgcaagcaggtctttcagtttgcagtcaaagaatcacttatcctgaagctgccaacagatgagctcatgaacccctcacagaagaagaaaagaaagcacagattgtgggctgcacactgcaggaagattcagctgaagaaagataactcttccacacaagtgtacaactaccaaccctgcgaccacccagaccgcccctgtgacagcacctgcccctgcatcatgactcagaatttctgtgagaagttctgccagtgcaacccagactgtcagaatcgtttccctggctgtcgctgtaagacccagtgcaataccaagcaatgtccttgctatctggcagtgcgagaatgtgaccctgacctgtgtctcacctgtggggcctcagagcactgggactgcaaggtggtttcctgtaaaaactgcagcatccagcgtggacttaagaagcacctgctgctggccccctctgatgtggccggatggggcaccttcataaaggagtctgtgcagaagaacgaattcatttctgaatactgtggtgagctcatctctcaggatgaggctgatcgacgcggaaaggtctatgacaaatacatgtccagcttcctcttcaacctcaataatgattttgtagtggatgctactcggaaaggaaacaaaattcgatttgcaaatcattcagtgaatcccaactgttatgccaaagtggtcatggtgaatggagaccatcggattgggatctttgccaagagggcaattcaagctggcgaagagctcttctttgattacaggtacagccaagctgatgctctcaagtacgtggggatcgagagggagaccgacgtcctttagccctcccaggccccacggcagcacttatggtagcggcactgtcttggctttcgtgctcacaccactgctgctcgagtctcctgcactgtgtctcccacactgagaaaccccccaacccactccctctgtagtgaggcctctgccatgtccagagggcacaaaactgtctcaatgagaggggagacagaggcagctagggcttggtctcccaggacagagagttacagaaatgggagactgtttctctggcctcagaagaagcgagcacaggctggggtggatgacttatgcgtgatttcgtgtcggctccccaggctgtggcctcaggaatcaacttaggcagttcccaacaagcgctagcctgtaattgtagctttccacatcaagagtccttatgttattgggatgcaggcaaacctctgtggtcctaagacctggagaggacaggctaagtgaagtgtggtccctggagcctacaagtggtctgggttagaggcgagcctggcaggcagcacagactgaactcagaggtagacaggtcaccttactacctcctccctcgtggcagggctcaaactgaaagagtgtgggttctaagtacaggcattcaaggctgggggaaggaaagctacgccatccttccttagccagagagggagaaccagccagatgatagtagttaaactgctaagcttgggcccaggaggctttgagaaagccttctctgtgtactctggagatagatggagaagtgttttcagattcctgggaacagacaccagtgctccagctcctccaaagttctggcttagcagctgcaggcaagcattatgctgctattgaagaagcattaggggtatgcctggcaggtgtgagcatcctggctcgctggatttgtgggtgttttcaggccttccattccccatagaggcaaggcccaatggccagtgttgcttatcgcttcagggtaggtgggcacaggcttggactagagaggagaaagattggtgtaatctgctttcctgtctgtagtgcctgctgtttggaaagggtgagttagaatatgttccaaggttggtgaggggctaaattgcacgcgtttaggctggcaccccgtgtgcagggcacactggcagagggtatctgaagtgggagaagaagcaggtagaccacctgtcccaggctgtggtgccaccctctctggcattcatgcagagcaaagcactttaaccatttcttttaaaaggtctatagattggggtagagtttggcctaaggtctctagggtccctgcctaaatcccactcctgagggagggggaagaagagagggtgggagattctcctccagtcctgtctcatctcctgggagaggcagacgagtgagtttcacacagaagaatttcatgtgaatggggccagcaagagctgccctgtgtccatggtgggtgtgccgggctggctgggaacaaggagcagtatgttgagtagaaagggtgtgggcgggtatagattggcctgggagtgttacagtagggagcaggcttctcccttctttctgggactcagagccccgcttcttcccactccacttgttgtcccatgaaggaagaagtggggttcctcctgacccagctgcctcttacggtttggtatgggacatgcacacacactcacatgctctcactcaccacactggagggcacacacgtaccccgcacccagcaactcctgacagaaagctcctcccacccaaatgggccaggccccagcatgatcctgaaatctgcatccgccgtggtttgtattcattgtgcatatcagggataccctcaagctggactgtgggttccaaattactcatagaggagaaaaccagagaaagatgaagaggaggagttaggtctatttgaaatgccaggggctcgctgtgaggaataggtgaaaaaaaacttttcaccagcctttgagagactagactgaccccacccttccttcagtgagcagaatcactgtggtcagtctcctgtcccagcttcagttcatgaatactcctgttcctccagtttcccatcctttgtccctgctgtcccccacttttaaagatgggtctcaacccctccccaccacgtcatgatggatggggcaaggtggtggggactaggggagcctggtatacatgcggcttcattgccaataaatttcatgcactttaaagtcctgtggcttgtgacctcttaataaagtgttagaatcc

SEQ ID NO: 9564 - DNA, 4525 bp, Homo sapiens
gcgcatgcgtcctagcagcgggacccgcggctcgggatggaggctggacacctgttctgctgttgtgtcctgccattctcctgaagaacagaggcacactgtaaaacccaacacttccccttgcattctataagattacagcaagatggaaataccaaatccccctacctccaaatgtatcacttactggaaaagaaaagtgaaatctgaatacatgcgacttcgacaacttaaacggcttcaggcaaatatgggtgcaaaggctttgtatgtggcaaattttgcaaaggttcaagaaaaaacccagatcctcaatgaagaatggaagaagcttcgtgtccaacctgttcagtcaatgaagcctgtgagtggacacccttttctcaaaaaggtagaagatgagacggttttgtgcaatattccctacatgggagatgaagtgaaagaagaagatgagacttttattgaggagctgatcaataactatgatgggaaagtccatggtgaagaagagatgatccctggatccgttctgattagtgatgctgtttttctggagttggtcgatgccctgaatcagtactcagatgaggaggaggaagggcacaatgacacctcagatggaaagcaggatgacagcaaagaagatctgccagtaacaagaaagagaaagcgacatgctattgaaggcaacaaaaagagttccaagaaacagttcccaaatgacatgatcttcagtgcaattgcctcaatgttccctgagaatggtgtcccagatgacatgaaggagaggtatcgagaactaacagagatgtcagaccccaatgcacttccccctcagtgcacacccaacatcgatggccccaatgccaagtctgtgcagcgggagcaatctctgcactccttccacacacttttttgccggcgctgctttaaatacgactgcttccttcacccttttcatgccacccctaatgtatataaacgcaagaataaagaaatcaagattgaaccagaaccatgtggcacagactgcttccttttgctggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcagaggctaactctcgctgtcagactcccacaaaacagaaggctagtccagccccacctcaactctgcgtagtggaagcaccctcggagcctgtggaatggactggggctgaagaatctctttttcgagtcttccatggcacctacttcaacaacttctgttcaatagccaggcttctggggaccaagacgtgcaagcaggtctttcagtttgcagtcaaagaatcacttatcctgaagctgccaacagatgagctcatgaacccctcacagaagaagaaaagaaagcacagattgtgggctgcacactgcaggaagattcagctgaagaaagataactcttccacacaagtgtacaactaccaaccctgcgaccacccagaccgcccctgtgacagcacctgcccctgcatcatgactcagaatttctgtgagaagttctgccagtgcaacccagactgtcagaatcgtttccctggctgtcgctgtaagacccagtgcaataccaagcaatgtccttgctatctggcagtgcgagaatgtgaccctgacctgtgtctcacctgtggggcctcagagcactgggactgcaaggtggtttcctgtaaaaactgcagcatccagcgtggacttaagaagcacctgctgctggccccctctgatgtggccggatggggcaccttcataaaggagtctgtgcagaagaacgaattcatttctgaatactgtggtgagctcatctctcaggatgaggctgatcgacgcggaaaggtctatgacaaatacatgtccagcttcctcttcaacctcaataatgattttgtagtggatgctactcggaaaggaaacaaaattcgatttgcaaatcattcagtgaatcccaactgttatgccaaagtggtcatggtgaatggagaccatcggattgggatctttgccaagagggcaattcaagctggcgaagagctcttctttgattacaggtacagccaagctgatgctctcaagtacgtggggatcgagagggagaccgacgtcctttagccctcccaggccccacggcagcacttatggtagcggcactgtcttggctttcgtgctcacaccactgctgctcgagtctcctgcactgtgtctcccacactgagaaaccccccaacccactccctctgtagtgaggcctctgccatgtccagagggcacaaaactgtctcaatgagaggggagacagaggcagctagggcttggtctcccaggacagagagttacagaaatgggagactgtttctctggcctcagaagaagcgagcacaggctggggtggatgacttatgcgtgatttcgtgtcggctccccaggctgtggcctcaggaatcaacttaggcagttcccaacaagcgctagcctgtaattgtagctttccacatcaagagtccttatgttattgggatgcaggcaaacctctgtggtcctaagacctggagaggacaggctaagtgaagtgtggtccctggagcctacaagtggtctgggttagaggcgagcctggcaggcagcacagactgaactcagaggtagacaggtcaccttactacctcctccctcgtggcagggctcaaactgaaagagtgtgggttctaagtacaggcattcaaggctgggggaaggaaagctacgccatccttccttagccagagagggagaaccagccagatgatagtagttaaactgctaagcttgggcccaggaggctttgagaaagccttctctgtgtactctggagatagatggagaagtgttttcagattcctgggaacagacaccagtgctccagctcctccaaagttctggcttagcagctgcaggcaagcattatgctgctattgaagaagcattaggggtatgcctggcaggtgtgagcatcctggctcgctggatttgtgggtgttttcaggccttccattccccatagaggcaaggcccaatggccagtgttgcttatcgcttcagggtaggtgggcacaggcttggactagagaggagaaagattggtgtaatctgctttcctgtctgtagtgcctgctgtttggaaagggtgagttagaatatgttccaaggttggtgaggggctaaattgcacgcgtttaggctggcaccccgtgtgcagggcacactggcagagggtatctgaagtgggagaagaagcaggtagaccacctgtcccaggctgtggtgccaccctctctggcattcatgcagagcaaagcactttaaccatttcttttaaaaggtctatagattggggtagagtttggcctaaggtctctagggtccctgcctaaatcccactcctgagggagggggaagaagagagggtgggagattctcctccagtcctgtctcatctcctgggagaggcagacgagtgagtttcacacagaagaatttcatgtgaatggggccagcaagagctgccctgtgtccatggtgggtgtgccgggctggctgggaacaaggagcagtatgttgagtagaaagggtgtgggcgggtatagattggcctgggagtgttacagtagggagcaggcttctcccttctttctgggactcagagccccgcttcttcccactccacttgttgtcccatgaaggaagaagtggggttcctcctgacccagctgcctcttacggtttggtatgggacatgcacacacactcacatgctctcactcaccacactggagggcacacacgtaccccgcacccagcaactcctgacagaaagctcctcccacccaaatgggccaggccccagcatgatcctgaaatctgcatccgccgtggtttgtattcattgtgcatatcagggataccctcaagctggactgtgggttccaaattactcatagaggagaaaaccagagaaagatgaagaggaggagttaggtctatttgaaatgccaggggctcgctgtgaggaataggtgaaaaaaaacttttcaccagcctttgagagactagactgaccccacccttccttcagtgagcagaatcactgtggtcagtctcctgtcccagcttcagttcatgaatactcctgttcctccagtttcccatcctttgtccctgctgtcccccacttttaaagatgggtctcaacccctccccaccacgtcatgatggatggggcaaggtggtggggactaggggagcctggtatacatgcggcttcattgccaataaatttcatgcactttaaagtcctgtggcttgtgacctcttaataaagtgttagaatcc

SEQ ID NO: 9565 - DNA, 4645 bp, Homo sapiens; identical to SEQ ID NO: 9563

SEQ ID NO: 9566 - DNA, 4404 bp, Homo sapiens
gcgcatgcgtcctagcagcgggacccgcggctcgggatggaggctggacacctgttctgctgttgtgtcctgccattctcctgaagaacagaggcacactgtaaaacccaacacttccccttgcattctataagattacagcaagatggaaataccaaatccccctacctccaaatgtatcacttactggaaaagaaaagtgaaatctgaatacatgcgacttcgacaacttaaacggcttcaggcaaatatgggtgcaaaggctttgtatgtggcaaattttgcaaaggttcaagaaaaaacccagatcctcaatgaagaatggaagaagcttcgtgtccaacctgttcagtcaatgaagcctgtgagtggacacccttttctcaaaaagagatgatccctggatccgttctgattagtgatgctgtttttctggagttggtcgatgccctgaatcagtactcagatgaggaggaggaagggcacaatgacacctcagatggaaagcaggatgacagcaaagaagatctgccagtaacaagaaagagaaagcgacatgctattgaaggcaacaaaaagagttccaagaaacagttcccaaatgacatgatcttcagtgcaattgcctcaatgttccctgagaatggtgtcccagatgacatgaaggagaggtatcgagaactaacagagatgtcagaccccaatgcacttccccctcagtgcacacccaacatcgatggccccaatgccaagtctgtgcagcgggagcaatctctgcactccttccacacacttttttgccggcgctgctttaaatacgactgcttccttcacccttttcatgccacccctaatgtatataaacgcaagaataaagaaatcaagattgaaccagaaccatgtggcacagactgcttccttttgctggaaggagcaaaggagtatgccatgctccacaacccccgctccaagtgctctggtcgtcgccggagaaggcaccacatagtcagtgcttcctgctccaatgcctcagcctctgctgtggctgagactaaagaaggagacagtgacagggacacaggcaatgactgggcctccagttcttcagaggctaactctcgctgtcagactcccacaaaacagaaggctagtccagccccacctcaactctgcgtagtggaagcaccctcggagcctgtggaatggactggggctgaagaatctctttttcgagtcttccatggcacctacttcaacaacttctgttcaatagccaggcttctggggaccaagacgtgcaagcaggtctttcagtttgcagtcaaagaatcacttatcctgaagctgccaacagatgagctcatgaacccctcacagaagaagaaaagaaagcacagattgtgggctgcacactgcaggaagattcagctgaagaaagataactcttccacacaagtgtacaactaccaaccctgcgaccacccagaccgcccctgtgacagcacctgcccctgcatcatgactcagaatttctgtgagaagttctgccagtgcaacccagactgtcagaatcgtttccctggctgtcgctgtaagacccagtgcaataccaagcaatgtccttgctatctggcagtgcgagaatgtgaccctgacctgtgtctcacctgtggggcctcagagcactgggactgcaaggtggtttcctgtaaaaactgcagcatccagcgtggacttaagaagcacctgctgctggccccctctgatgtggccggatggggcaccttcataaaggagtctgtgcagaagaacgaattcatttctgaatactgtggtgagctcatctctcaggatgaggctgatcgacgcggaaaggtctatgacaaatacatgtccagcttcctcttcaacctcaataatgattttgtagtggatgctactcggaaaggaaacaaaattcgatttgcaaatcattcagtgaatcccaactgttatgccaaagtggtcatggtgaatggagaccatcggattgggatctttgccaagagggcaattcaagctggcgaagagctcttctttgattacaggtacagccaagctgatgctctcaagtacgtggggatcgagagggagaccgacgtcctttagccctcccaggccccacggcagcacttatggtagcggcactgtcttggctttcgtgctcacaccactgctgctcgagtctcctgcactgtgtctcccacactgagaaaccccccaacccactccctctgtagtgaggcctctgccatgtccagagggcacaaaactgtctcaatgagaggggagacagaggcagctagggcttggtctcccaggacagagagttacagaaatgggagactgtttctctggcctcagaagaagcgagcacaggctggggtggatgacttatgcgtgatttcgtgtcggctccccaggctgtggcctcaggaatcaacttaggcagttcccaacaagcgctagcctgtaattgtagctttccacatcaagagtccttatgttattgggatgcaggcaaacctctgtggtcctaagacctggagaggacaggctaagtgaagtgtggtccctggagcctacaagtggtctgggttagaggcgagcctggcaggcagcacagactgaactcagaggtagacaggtcaccttactacctcctccctcgtggcagggctcaaactgaaagagtgtgggttctaagtacaggcattcaaggctgggggaaggaaagctacgccatccttccttagccagagagggagaaccagccagatgatagtagttaaactgctaagcttgggcccaggaggctttgagaaagccttctctgtgtactctggagatagatggagaagtgttttcagattcctgggaacagacaccagtgctccagctcctccaaagttctggcttagcagctgcaggcaagcattatgctgctattgaagaagcattaggggtatgcctggcaggtgtgagcatcctggctcgctggatttgtgggtgttttcaggccttccattccccatagaggcaaggcccaatggccagtgttgcttatcgcttcagggtaggtgggcacaggcttggactagagaggagaaagattggtgtaatctgctttcctgtctgtagtgcctgctgtttggaaagggtgagttagaatatgttccaaggttggtgaggggctaaattgcacgcgtttaggctggcaccccgtgtgcagggcacactggcagagggtatctgaagtgggagaagaagcaggtagaccacctgtcccaggctgtggtgccaccctctctggcattcatgcagagcaaagcactttaaccatttcttttaaaaggtctatagattggggtagagtttggcctaaggtctctagggtccctgcctaaatcccactcctgagggagggggaagaagagagggtgggagattctcctccagtcctgtctcatctcctgggagaggcagacgagtgagtttcacacagaagaatttcatgtgaatggggccagcaagagctgccctgtgtccatggtgggtgtgccgggctggctgggaacaaggagcagtatgttgagtagaaagggtgtgggcgggtatagattggcctgggagtgttacagtagggagcaggcttctcccttctttctgggactcagagccccgcttcttcccactccacttgttgtcccatgaaggaagaagtggggttcctcctgacccagctgcctcttacggtttggtatgggacatgcacacacactcacatgctctcactcaccacactggagggcacacacgtaccccgcacccagcaactcctgacagaaagctcctcccacccaaatgggccaggccccagcatgatcctgaaatctgcatccgccgtggtttgtattcattgtgcatatcagggataccctcaagctggactgtgggttccaaattactcatagaggagaaaaccagagaaagatgaagaggaggagttaggtctatttgaaatgccaggggctcgctgtgaggaataggtgaaaaaaaacttttcaccagcctttgagagactagactgaccccacccttccttcagtgagcagaatcactgtggtcagtctcctgtcccagcttcagttcatgaatactcctgttcctccagtttcccatcctttgtccctgctgtcccccacttttaaagatgggtctcaacccctccccaccacgtcatgatggatggggcaaggtggtggggactaggggagcctggtatacatgcggcttcattgccaataaatttcatgcactttaaagtcctgtggcttgtgacctcttaataaagtgttagaatcc

SEQ ID NO: 9567 - DNA, 2639 bp, Homo sapiens
tccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatcgtaagtgcaattattcttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttg

SEQ ID NO: 9568 - DNA, 2477 bp, Homo sapiens
agaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggaggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttg

SEQ ID NO: 9569 - DNA, 2591 bp, Homo sapiens
aggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggagtgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttg

SEQ ID NO: 9570 - DNA, 1491 bp, Homo sapiens
aaataaaagcgatggcgattgggctgccgcgtttggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttctgtgagctcattgcgcgggactagggaggccattcacctgctcttccctctacgattttccataacacagtttttacttggaaccagccttctgccaagagtctcagtttggttgtgtactcctacaactactatttttggcttgacttccctctccagctcccagtggtccagccacacagtcgcctattgtaccagctggttgattgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttgccactcctacctaggaactaaatgggtatatattgcctgttggattttggacagaagattcattgaatggcacctgcagaaggagggagcaaaggagtttgctgctgctctcaccgctgagcggataaagaccccaccaaaacgtccaggaggccgcagaaga

SEQ ID NO: 9571 - DNA, 2471 bp, Homo sapiens
tccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttcttgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaagggtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttg

SEQ ID NO: 9572 - DNA, 2572 bp, Homo sapiens
gacgacgttcgcggcggggaactcggagtagcttcgcctctgacgtttccccacgacgcaccccgaaatccccctgagctccggcggtcgcgggctgccctcgccgcctggtctggctttatgctaagtttgagggaagagtcgagctgctctgctctctattgattgtgtttctggagggcgtcctgttgaattcccacttcattgtgtacatccccttccgttccccccaaaaatctgtgccacagggttactttttgaaagcgggaggaatcgagaagcacgatcttttggaaaacttggtgaacgcctaaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttcttgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaagggtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattg

SEQ ID NO: 9573 - DNA, 2466 bp, Homo sapiens
ggcgctcggtccggtcgcgtccgacacccggtgggactcagaaggcagtggagccccggcggcggcggcggcggcgcgcgggggcgacgcgcgggaacaacgcgagtcggcgcgcgggacgaagaataatcatgggccagactgggaagaaatctgagaagggaccagtttgttggcggaagcgtgtaaaatcagagtacatgcgactgagacagctcaagaggttcagacgagctgatgaagtaaagagtatgtttagttccaatcgtcagaaaattttggaaagaacggaaatcttaaaccaagaatggaaacagcgaaggatacagcctgtgcacatcctgacttcttgttcggtgaccagtgacttggattttccaacacaagtcatcccattaaagactctgaatgcagttgcttcagtacccataatgtattcttggtctcccctacagcagaattttatggtggaagatgaaactgttttacataacattccttatatgggagatgaagttttagatcaggatggtactttcattgaagaactaataaaaaattatgatgggaaagtacacggggatagagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatgataaagaaagccgcccacctcggaaatttccttctgataaaatttttgaagccatttcctcaatgtttccagataagggcacagcagaagaactaaaggaaaaatataaagaactcaccgaacagcagctcccaggcgcacttcctcctgaatgtacccccaacatagatggaccaaatgctaaatctgttcagagagagcaaagcttacactcctttcatacgcttttctgtaggcgatgttttaaatatgactgcttcctacatccttttcatgcaacacccaacacttataagcggaagaacacagaaacagctctagacaacaaaccttgtggaccacagtgttaccagcatttggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaagaatctagcatcatagctccagctcccgctgaggatgtggatactcctccaaggaaaaagaagaggaaacaccggttgtgggctgcacactgcagaaagatacagctgaaaaaggacggctcctctaaccatgtttacaactatcaaccctgtgatcatccacggcagccttgtgacagttcgtgcccttgtgtgatagcacaaaatttttgtgaaaagttttgtcaatgtagttcagagtgtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaagcatctattgctggcaccatctgacgtggcaggctgggggatttttatcaaagatcctgtgcagaaaaatgaattcatctcagaatactgtggagagattatttctcaagatgaagctgacagaagagggaaagtgtatgataaatacatgtgcagctttctgttcaacttgaacaatgattttgtggtggatgcaacccgcaagggtaacaaaattcgttttgcaaatcattcggtaaatccaaactgctatgcaaaagttatgatggttaacggtgatcacaggataggtatttttgccaagagagccatccagactggcgaagagctgttttttgattacagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgta

SEQ ID NO: 9574 - DNA, 1783 bp, Homo sapiens
ggacagtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtctagagtcatgtgagcctcgtgtcatctccggggtggccacaggctagatccccggtggttttgtgctcaaaataaaaagcctcagtgacccatgagaa

SEQ ID NO: 9575 - DNA, 2423 bp, Homo sapiens
acccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgc

SEQ ID NO: 9576 - DNA, 2827 bp, Homo sapiens
ctcttcacttcccgctgcaacccccagggactgcagggcctttctcaggaccctcttccccgacacctgtattgcatgcgcctttcgcgggaagaggagggatacacgtttgggagagagtgggaccttggggaaggggcagtgttcaggcagctggggtgttaagttggggaggtatgggggctctggaagagaggcccaggcagcccatcctcttcttggctcccaggagaaatgcaagcctggcagccattccgctctgaggagatctgggggaaccccaccggctggccaagctgcaaagaggcgcgggaaccactgtcgtgcccctcccctcctcactgcagtgttctcccatctcatcatttgatcttaccccgccccccactgcagtgacctccccttcctcactgcattgaccttctcctcttcccaggggggagggggaatcccttctacagccctagactgcagccagcgcctccctacccaccccccacccactgcagtaacctctttcccatccctcccagcctcccgccccgcccattgatctcaggctccacccctctaagcctcttatctttctccttccttcccttccacccgaggagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgc

SEQ ID NO: 9577 - DNA, 1646 bp, Homo sapiens
gctctctcagcgccgccgtcgccaccgccaccgccaccgccactaccaccgtctgagtctgcagtcccgaggagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaagccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgt

SEQ ID NO: 9578 - DNA, 2549 bp, Homo sapiens
ctgttactgtcgagtgggtcgggccgtgggtatgagcgcttgtgtgcgctggggccaggtcgtgggtgcccccacccttcccccatcctcctcccttccccactccaccctcgtcggtcccccacccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgaggagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgc

SEQ ID NO: 9579 - DNA, 1643 bp, Homo sapiens
gctctctcagcgccgccgtcgccaccgccaccgccaccgccactaccaccgtctgagtctgcagtcccgagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaagccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgt

SEQ ID NO: 9580 - DNA, 1322 bp, Homo sapiens
gacactgtcccagctgccacctagactcggagctccatccaaacctccagcgaagacatcccagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaagccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccacttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaacc

SEQ ID NO: 9581 - DNA, 1521 bp, Homo sapiens
gcgcagcctgagagggggtgagctgacactgtcccagctgccacctagactcggagctccatccaaacctccagcgaagacatcccaggtcgggtgaatcttccagccctgggggtggaggtagtaaaggccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaagaaactaagcgttgtggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccacttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaaga

SEQ ID NO: 9582 - DNA, 1448 bp, Homo sapiens
aaagggcaagggatttctggttccttaagagatcaactgtctacactcactcacacctcctgtcctgcagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaagaaactaagcgttgtggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccacttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactg

SEQ ID NO: 9583 - DNA, 945 bp, Homo sapiens
ataaatgcgcagcctgagagggggtgagctgacactgtcccagctgccacctagactcggagctccatccaaacctccagcgaagacatcccagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaagaaactaagcgttgtggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagcttt

SEQ ID NO: 9584 - DNA, 561 bp, Homo sapiens
gacactgtcccagctgccacctagactcggagctccatccaaacctccagcgaagacatcccaggtcgggtgaatcttccagccctgggggtggagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaagaaactaagcgttgtggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacg

SEQ ID NO: 9585 - DNA, 563 bp, Homo sapiens
acttattcaagtaataagaaagcaaagaagagtttggccaaatcctctagtcgctctcatagctgaaggcacccaccggggccacttctgtccccagcgtcttctcgggtcgtgcagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaagaaactaagcgttgtggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgcca

SEQ ID NO: 9586 - DNA, 1867 bp, Homo sapiens
cgctcccgccctcccgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagggctggcacctagacattaaactgtaatttgaaaataagcaacatgttgcataacttgttggaataattccttgttctgtttaacacttgtcataaattagcagaataaaaatagtcgtgcaacaccgggggtatctggtatgcaacgaagggaaaaatatttcactgattaaccccgaa

SEQ ID NO: 9587 - DNA, 2382 bp, Homo sapiens
aatagagacagggtttcgctatgttgatcaggctggtcctgaactcctgacctcaggtgatccgcctgcctcagcctcccaaagtgctgggattataggcgtgagccactgcacccagccaggtgggtctttaatatcagcaaccctttgcttccatgtaatttccagccagaggtcccagttcccaagagccaggctgttcctcttccacttgagtgccctcctctccctccaggccacctcctttccacactgctcatctgcacttctcccttctgactctcgcctgtgcaggtaaagacctctggccatcctaagaccttctctggatgaacctcgatggttgatgaccctgcatcctgaaacagggcaggatgcagagggaccatcatctcttttgacccagtcactgtgtgtccctcagcacagctcacggtggcactttttgcctgtgacatgtcaccaggcttcctatctgacttgcagccactctggtctctgagcctcctgctactcagtgtgtcctgtggagcaggagctccagcatcacctgggagcttgtgagaaatgcagcctgggcctctccccagacccgctgcctgggaatctgcattggaacaagatcccctagtgattcctatgcgttcttaagttggagaggcactgaattcttgttaatgcctcagctaaataaaggcttgaggagtgagaacttgaaggaggcagcatgaagccgcggaaagaggtgttggcatctgatagaactgaaatcacatcttgccttttcccctcatccgctgcaagtacttgctgtgtgatcaattactcaacctctctgaacttcattttctctcagtagaaataatatgagctttggtcctcctccaagttgccatatctcagaaggaccagcacagggcaggattcagagcagctgctgtaagtgctgtttgccctccctctgcatacccgggggaggctgcagcagtgtatctggtgagtcagagaaggctgtggggagatttaaagggtctcttcccagcacaggaagcctggcacccagagcctaaggccagccaccctctctggagcatcacggatcatgtagttgaagcctccagctggtacagaagagaacagcaggtgcctgagaatgtgcggcactctgcaagctggggctctttgcaaagcagcagggggacctcagccaaggaggcgcacagggagggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaaagcaaaaagaacttttacctcggcatccagcccaacccctaaagactgacaatatccttcgagctcctttgaaagcaccctaaacagccatttccattttaatagttggatgcggattgtacccttcaatctgaaagtcttcagctttgaagtcatcaattttctcaacttttcgaagaatcctgagctttgggaaaggtctgggttctcgctgaagctaaaaacaaaataaggccattattttgccataattgtacgacctgttgtaattgctcctcatgtccgtgaaacaagtacacaggatgtgatcaacaaagttctattttacagg

SEQ ID NO: 9588 - DNA, 1658 bp, Homo sapiens
gcttccccacgtcgcttgggggccacggcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatggtaagcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaagtaattattacttgattcttttagcaaatcaatgcacgttatcctacttaatccttaaataagtttagatttaactaacccaaagtccaggaggatgttcttacaaaaatagctatatcaagg

SEQ ID NO: 9589 - DNA, 1966 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgattggtccagaaaagggcgtggtgcacctggcgacagcggccgtcctaaacgcggtgtgggacttgtgggccaagcaggagggaaagcctgtctggaagttacttgtggacatggatcccaggatgctggtatcctgcatagatttcaggtacatcactgatgtcctgactgaggaggatgccctagaaatactgcagaaaggtcaaattggtaaaaaagaaagagagaagcaaatgctggcacaaggataccctgcttacacgacatcgtgcgcctggctggggtactcagatgacacgttgaagcagctctgtgcccaggcgctgaaggatggctggaccaggtttaaagtaaaggtgggtgctgatctccaggatgacatgcgaagatgccaaatcatccgagacatgattggaccggaaaagactttgatgatggatgccaaccagcgctgggatgtgcctgaggcggtggagtggatgtccaagctggccaagttcaagccattgtggattgaggagccaacctcccctgatgacattctggggcacgccaccatttccaaggcactggtcccattaggaattggcattgccacaggagaacagtgccacaatagagtgatatttaagcaactcctacaggcgaaggccctgcagttcctccagattgacagttgcagactgggcagtgtcaatgagaacctctcagtattgctgatggccaaaaagtttgaaattcctgtttgcccccatgctggtggagttggcctctgtgaactggtgcagcacctgattatatttgactacatatcagtttctgcaagccttgaaaatagggtgtgtgagtatgttgaccacctgcatgagcatttcaagtatcccgtgatgatccagcgggcttcctacatgcctcccaaggatcccggctactcaacagaaatgaaggaggaatctgtaaagaaacaccagtatccagatggtgaagtttggaagaaactccttcctgctcaagaaaattaagtgctcagccccaacaacttttttctttctgaagtgaaagggcttaaaatttcttggaaatagttttacaaaaatggatttaaaaaatcctaccgatcaagatgagttcagctagaagtcataccaccctcaggaatcagctaaagcaaaaagaacttttacctcggcatccagcccaacccctaaagactgacaatatccttcgagctcctttgaaagcaccctaaacagccatttccattttaatagttggatgcggattgtacccttcaatctgaaagtcttcagctttgaagtcatcaattttctcaacttttcgaagaatcctgagctttgggaaaggtctgggttctcgctgaagctaaaaacaaaataaggccattattttgccataattgtacgacctgttgtaattgctcctcatgtccgtgaaacaagtacacaggatgtgatcaacaaagttctattttacaggagtatgatcctgtcgataccttgccgtaggttatgtaacatgattggagcgcaaccagctgttctcttgcacagatcgagagtgaggggtattttgtgacattacacagcatcaggagcctggtgcctcatcaggtgtaagttcttataaccactcttggcaaatttattaaagacaggaacacagtcaatctgtaactc

SEQ ID NO: 9590 - DNA, 886 bp, Homo sapiens
cgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaaggcactgaagttgttgtctgtgctgtgaatgccctcgcccaccatgtgctcaacaaggacctcaaggacattgttggtgacttcagaggcttctataggcagctcacaagtgatgggcagctcagatggattggtccagaaaagggcgtggtgcacctggcgacagcggccgtcctaaacgcggtgtgggacttgtgggccaagcaggagggaaagcctgtctggaagttacttgtggacatggggtgaacaactggatgctgaggaggaaaaaactgggcaaattaaaggggaatgagcttcagaccccatgcagagctggctgtgagtccgggtttcactgctcaccagctgcatgaccttgagcatgtgacttccccactctgagctgcggtggcctcagtgcaacacctgggtggcggttaaaaacctcgtgatccacaaatgaaggcccttgttattagttggcaaaaaattaaggaaaaacaaagaacaccatggccttgaagagtgttgggcaggagactgctcctcctccggaggaaagtgaagacaggaggctgtcacatcgtctctgacatggagagtggcttccgggccatccgtaggggaaggacacagagctcttgagcccccttctagattcaaggatcccaggatgctggtatcctgcatagatttca

SEQ ID NO: 9591 - DNA, 1257 bp, Homo sapiens
gctcaacatggcggccttctgtgcccgccccctccgctaacgggcacgttactccgtccgaacgcagtagacgaaggcggcggcgatggcggcggggatagtggcttctcgcagactccgcgacctactgacccggcgactgacaggctccaactacccgggactcagtattagccttcgcctcactggctcctctgcacaagaggaggcttccggagtagccctcggtgaagccccagaccacagctatgagtcccttcgtgtgacgtctgcgcagaaacatgttctgcatgtccagctcaaccggcccaacaagaggaatgccatgaacaaggtcttctggagagagatggtagagtgcttcaacaagatttcgagagacgctgactgtcgggcggtggtgatctctggtgcaggaaaaatgttcactgcaggtattgacctgatggacatggcttcggacatcctgcagcccaaaggagatgatgtggcccggatcagctggtacctccgtgacatcatcactcgataccaggagaccttcaacgtcatcgagaggtgccccaagcccgtgattgctgccgtccatgggggctgcattggcggaggtgtggaccttgtcaccgcctgtgacatccggtactgtgcccaggatgctttcttccaggtgaaggaggtggacgtgggtttggctgccgatgtaggaacactgcagcgcctgcccaaggtcatcgggaaccagagcctggtcaacgagctggccttcaccgcccgcaagatgatggctgacgaggccctgggcagtgggctggtcagccgggtgttcccagacaaagaggtcatgctggatgctgccttagcgctggcggccgagatttccagcaagagccccgtggcggtgcagagcaccaaggtcaacctgctgtattcccgcgaccattcggtggccgagagcctcaactacgtggcgtcctggaacatgagcatgctgcagacccaagacctcgtgaagtcggtccaggccacgactgagaacaaggaactgaaaaccgtcaccttctccaagctctgagagccctcgcgtcccaggccccagccagggggccggccttgtcccgcctcatccacagaaagggaggatgggcgatgacagttgtttctatgccttctgacccagtttcccagtttataactttatgacaatgagtttctcaagcccaaggccttatcttcaccccacaaacaataaagcaaagt

SEQ ID NO: 9592 - DNA, 1361 bp, Homo sapiens
gacacgagggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggactccagaggagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggctt

SEQ ID NO: 9593 - DNA, 909 bp, Homo sapiens
aagtcaccaccgtggcctgcgacggaccctttccagctttttgcctgaaagctttgcagaagaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaattta

SEQ ID NO: 9594 - DNA, 2285 bp, Homo sapiens
gtgacacgagggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggaaacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgcatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtct

SEQ ID NO: 9595 - DNA, 1354 bp, Homo sapiens
ggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaa

SEQ ID NO: 9596 - DNA, 2455 bp, Homo sapiens
gtgacacgagggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggaaagttgcagatggaatacagagttcctgtacaccctgcatccagtttccccttttattaacatcttatattcctatggatggaatggccgtatgcatgttcatgcaaaacaccttaacaagatttatgaggtaaagaagcaaagaggaaaaattcttcttggcctatcaagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgcatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtct

SEQ ID NO: 9597 - DNA, 1009 bp, Homo sapiens
acgcaaaacggaaaagcgtgtgtaggggagcggaaaaggaagtcaccaccgtggcctgcgacggaccctttccagctttttgcctgaaagctttgcagaagaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataa

SEQ ID NO: 9598 - DNA, 1515 bp, Homo sapiens
gatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaaca

SEQ ID NO: 9599 - DNA, 2341 bp, Homo sapiens
gtgacacgagggagcgcgaagcggagggcgcctcgcggcaggagcgggatttccggggtcacgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgcatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaaca

SEQ ID NO: 9600 - DNA, 2443 bp, Homo sapiens
ggcctgcgacggtaagtggtcgtaagggttggtcttagcgcttcagtttagtgttgtcagtgggagaatcctaaaatgtcgccgtggaatggactgtaccgctcgcttctccaaacgtgtcccagacggcgagcctccccggctccgcggcttgtcccttgcaagcgccgcgcaggcctgccccgcgctggacgtggagacgcggtgccgagcgccacgggccggctgtgcgccggccggggaaagagggcgaggggaagagatgaatcggtcttcccagagcgcgccgcgaggtcgcgagattacactttaaaaagcatgaggaggcttgctttctacatgctgatttaatttcggaatacattcgaggccctgtgctaagttagaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgcatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtg

SEQ ID NO: 9601 - DNA, 531 bp, Homo sapiens
aacattccaggaagggaagccagcctgtgaagaagcatggcattgaaacaggtggcttggtagtgagcttgttcagctccactgaatcttctttgtggtggggctgcaagacatcctgcatgaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaag

SEQ ID NO: 9602 - DNA, 2585 bp, Homo sapiens
caagaacgaaagatgagcaactcctttctggtagaggttctttcattggagaatttttgagctacaataatccttttaacgctgcgcacacatacagggattacacgtgtaggggattaaaaacacagttaagtttaggttgaaggtgctgttaaggacttcaggcaacattaaatcaacactcagttctttgctctgttccacatctgggctcctgtatagcagttgttgctctaggtgctagaggtatgcagaggaactggacaagggcaaggaaaacaaagggctccttctttagaagagctagcattctcttggaacagacaagcttgtggtgagaagtatatttgtgaaatctacgaggggagggagcagcgcagtaatagaacgggcgatcctttcttgattttttattgggttctggcctgaaaggcgactgtataatcagctgggattcctgcaatgattaacattccaggaagggaagccagcctgtgaagaagcatggcattgaaacaggaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgcatttgccttaccatcatgatcctactgttgagttaggaaaatatggttagacagactcacattactttttttcagaggtaaactctagattactgtgtcaacccaatactatttggccatagatgtaaaaactaccaaataaaagtggattttgtggtctacaa

SEQ ID NO: 9603 - DNA, 577 bp, Homo sapiens
gtggcctgcgacgtggcttggtagtgagcttgttcagctccactgaatcttctttgtggtggggctgcaagacatcctgcatggaccctttccagctttttgcctgaaagctttgcagaagaaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggatggaatggccgtatgcatgttcatgcaaaacaccttaacaagatttatgagacttcctttaataagtgttgcgctggttcaaggttggg

SEQ ID NO: 9604 - DNA, 1966 bp, Homo sapiens
aaatggcgaaaagtcttttgaagacagcctctctgtctggaaggacaaaattgctacatcaaacaggattgtcactttatagtacatcccatggattttatgaggaagaagtgaaaaaaacacttcagcagtttcctggtggatccattgaccttcagaaggaagacaatggcattggcattcttactctgaacaatccaagtagaatgaatgccttttcaggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagaggcaaacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaacagtggtagccatgacatggaaagtcaactgattctacaattggacattcatttgtgtgccctggaatttccaactagtaataaacaactactgttgatgtagttttaaaccacttgaagggactcatgaagcatcctgcaacataaatttgcatttttacatcagatttcttttttttcctgaaaaacaactaaccttctaacaactatctttcaaaagtaaatgtaataaaaatgcacaacataaaatgtttatgatcccagcaatacactttttaaaaaatgtgaaagtcaaagaattaagttctagttctgactcatcacaagaggtcaaaagtatttgctactgtaacattcaattcacatttgagaatcatggtaaaaataacttgcatttgccttaccatcatgatcctactgttgagttaggaaaatatggttagacagactcacattactttttttcagaggtaaactctagattactgtgtcaacccaatactattt

SEQ ID NO: 9605 - DNA, 1449 bp, Homo sapiens
acgggaaccggcaggggaacgggataaagttcccggagaaaggaaaggagagcgtgggatagtaaaagagaagacgcggagaagaggagaggacctacaagaacggaggacaggggcgcacgatggtcccggggggagcggaaacaaaggcacgcaaaacggaaaagcgtgtgtaggggagcggaaaaggaagtcaccaccgtggcctgcgacggtgttatgatgctacaacttctggaaaaagtaattgaattggaaaattggacagaggggaaaggcctcattgtccgtggggcaaaaaatactttctcttcaggatctgatctgaatgctgtgaaatcactaggaactccagagacttcctttaataagtgttgcgctggttcaaggttgggcattgggtggaggagcagaatttactacagcatgtgatttcaggttaatgactccagagagtaagatcagattcgtccacaaagagatgggcataataccaagctggggtggcaccacccggctagttgaaataatcggaagtagacaagctctcaaagtgttgagtggggcccttaaactggattcaaaaaatgctctaaacataggaatggttgaagaggtcttgcagtcttcagatgaaactaaatctctagaagaggcacaagaatggctaaagcaattcatccaagggccaccggaagtaattagagctttgaaaaaatctgtttgttcaggcagagagctatatttggaggaagcattacagaacgaaagagatcttttaggaacagtttggggtgggcctgcaaatttagaggctattgctaagaaaggaaaatttaataaataattggtttttcgtgtggatgtactccaagtaaagctccagtgactaatatgtataaatgttaaatgatattaaatatgaacatcagaattactttgaaggctactattaatatgcagacttacttttaatcatttgaatatctgaactcatttacctcatttcttgccaattactcacttgggtatttactgcgtaatctggaacatttagctaaaatatacacttttggcttaaaaattattgctgtcaattccaataataattcttagcttataaccaaagagcagtgtttaaaaggagagcttctatacaaaacctattcctggcgttacttttcatacaatttttgttctgttttacctggaaataatttaccaaaataactgagtgttgctgctaaagaacaaaagtggggaggtatcagggaacaagaaaacaagaaagggtatgatcaatcattttcttctgctccaaacagctggagtaaaattcatgggaaatggcccttcatttaaaaaaagatgtacctcactacccactacaaatttggaactttgttcttttcaataattagttttctattgtaaattacctactaaaca

SEQ ID NO: 9606 - DNA, 1617 bp, Homo sapiens
cggcgcagagcccggcaggcgccgccgttgcctccgcctccgcgcggtctccccggggccagctgggaccccgagggctggggcgggggcgggggcgcgggcgactgcggcggggcctggagggcgctggtcccagcccagggcggggtcccggggacgcccctcggccttagatccgcgagcggcagctcgggcctgggggcggggcctggcggagagcgacccgctcactctgcccgggctgatctcgcgagggccgcctggtctcgcggcgctggcctgtgggcggagcgagccctgaaaggctataggcgagggggcggctccgcggggccgggcgaggagtccagagagccatggccgccctgcgtgtcctgctgtcctgcgtccgcggcccgctgaggcccccggttcgctgtcccgcctggcgtcccttcgcctcgggtgctaactttgagtacatcatcgcagaaaaaagagggaagaataacaccgtggggttgatccaactgaaccgccccaaggccctcaatgcactttgcgatggcctgattgacgagctcaaccaggccctgaagaccttcgaggaggacccggccgtgggggccattgtcctcaccggcggggataaggcctttgcagctggagctgatatcaaggaaatgcagaacctgagtttccaggactgttactccagcaagttcttgaagcactgggaccacctcacccaggtcaagaagccagtcatcgctgctgtcaatggctatgcctttggcgggggctgtgagcttgccatgatgtgtgatatcatctatgccggtgagaaggcccagtttgcacagccggagatcttaataggaaccatcccaggtgcgggcggcacccagagactcacccgtgctgttgggaagtcgctggcgatggagatggtcctcactggtgaccggatctcagcccaggacgccaagcaagcaggtcttgtcagcaagatttgtcctgttgagacactggtggaagaagccatccagtgtgcagaaaaaattgccagcaattctaaaattgtagtagcgatggccaaagaatcagtgaatgcagcttttgaaatgacattaacagaaggaagtaagttggagaagaaactcttttattcaacctttgccactgatgaccggaaagaagggatgaccgcgtttgtggaaaagagaaaggccaacttcaaagaccagtgagaaccagctgcccctgcttcacacctctgcttggagaggacaagtgcagcctgtcagttttagaagcaagtaaatcatcctcttttcaagagcagtgtccgtggtgtgcagttcctctccaattgctgcgtggtcgtggcccgacctctcacggcatgacagccttcgtcacccagcctgtgagggtcctgactggagcaccttctaaatctaagattctgctgaggagcccccgctggtccctctgggcatgctgtgctcggacggaaagcggggcctgcgggtccttgtgtccctgccgctgaagaatggggctgctctgagggaaacgctgtctgctgccttcatacagatgctgattaaagtgatagcgattcagattacacca

SEQ ID NO: 9607 - DNA, 3850 bp, Homo sapiens
gaggaggccgggcgcgcccggaaaagtggtttgcctgacggcgagaggcagaggtgccctcggtgatagaggaaacatggccgagtatacgcggctgcacaacgccttggcgctaatccgcctccgaaacccgccggtcaacgcgatcagtacgactttactccgtgacataaaagaaggactacagaaagctgtaatagaccatacaataaaagccattgtgatttgtggagcagagggcaaattttctgcaggtgctgatattcgtggcttcagtgctcctaggacatttggccttacactgggacatgtagtagatgaaatacagagaaatgagaagcccgtggtggcagcaatccaaggcatggctttcggagggggactagagctggccctgggctgtcactataggattgcccacgcagaggctcaagttggcttaccagaagttacactgggacttctccctggtgcaagaggaacccagcttctccccagactcactggagttcctgctgcacttgacttaattacctcaggaagacgtattttagcagatgaagcactcaagctgggcattctagataaagttgtaaactcagacccggttgaagaagcaatcagatttgctcagagagtttcagatcaacctctagaatcccgtagactctgcaacaagccaattcagagcttgcccaacatggacagcatttttagtgaggccctcttgaagatgcggaggcagcaccctgggtgtcttgcacaggaggcttgtgtccgtgcagtccaggctgctgtgcagtatccctatgaagtgggcatcaagaaggaggaggagctgtttctatatcttttgcaatcagggcaggctagagccctgcaatatgctttcttcgctgaaaggaaagcaaataagtggtcaactccctccggagcatcgtggaaaacagcatcagcgcggcctgtctcctcagttggtgttgttggcttgggaacaatgggccgaggcattgtcatttcttttgcaagggccaggattcctgtgattgctgtagactcggacaaaaaccagctagcaactgcaaacaagatgataacctctgtcttggaaaaagaagcctccaaaatgcaacagagcggccacccttggtcaggaccaaaacccaggttaacttcatctgtgaaggagcttggtggtgtagatttagtcattgaagcagtatttgaggaaatgagcctgaagaagcaggtctttgctgaactctcagctgtgtgcaaaccagaagcatttttgtgcactaatacttcagccctggatgttgatgagattgcttcttccactgatcgtcctcacttggtcattggcacccacttcttttcgccagctcatgtcatgaagttgttagaggttattcccagccaatactcttcccccactaccattgccactgttatgaacttatcaaaaaagattaaaaagattggagtcgttgtaggcaactgttttggatttgtggggaatcgaatgttgaatccttactacaatcaggcatatttcttgttagaagaaggcagcaaaccagaggaggtagatcaggtgctggaagagtttggttttaaaatgggaccttttagagtgtctgatcttgctgggttggatgtgggctggaaatctagaaaggggcaaggtcttactggacctacattgcttccaggaactcctgcccgaaaaaggggtaataggaggtactgcccaattcctgatgtgctctgtgaattaggacgatttggccagaagacaggtaagggttggtatcaatatgacaagccattgggtaggattcacaaacctgatccctggctttccaaattcctatcacggtatagaaaaacccatcacattgaaccacgtaccattagccaggatgagatccttgaacgctgcttatattcacttatcaatgaagcattccgtatcttgggagaagggatagctgctagcccagagcacattgatgttgtctatttacatggatatggatggccaaggcacaagggcgggcccatgttctatgcttccacagttgggttgcccacagttctagagaaattgcagaaatattacaggcagaaccctgatattccccaactggagccaagtgactatctaaaaaaactggcttctcagggaaaccctcccctgaaagaatggcaaagcttggcaggctcccctagcagtaaattgtgattcagtcttccagattatgcctcacatgctagcatcaggtaatgctgactgaatttcagtgaaattaaatcaaaaatccaaagtaagattgttctgaaatacaaagcaaaataaataatcattagaatcttctgtgtaacgactctaatggtcaaatctttaggaatgtgcttcctatgcctctgaatctgtccttatcagataaattcaatgcatgaacttgtgtgaatataataccataatagctaatgaaagaggctcaggcataagttgagattctcaaatgcttttatcattggataaatgtgtcatcaattaataaatgataaatgcagctaagtcatacattcattttgactcctttcaatgtcacacacatagtattgatcagaaatcttatgaatcatacatacactcaacaaacattaaagttgtaggaaaaagacagttggaaattggtaagggaactgagtacttcaaaccagcacagggaacttaggttagtgtggcaagcctttcctcttctggtctttcctcttctgtttatggagaaataatagaaagtagtaagtcgttaacttagtgtaagaagggtcttagagaacatctaaccttctaggatttcccaattctgtgatagagtaatgacaccagttttcctgtcatgacaagcctctgtgatgttacatatggaaatggttgaatcttgaaaaatctaaaattgttgcaaaacatattttgtatgattttgttgtaagagttcttctctttttactttttgccttgtgtagttaaaaattaaggggctggtcaatacaaaaacttgtacacaaatatttatagcagaattattcataatggccaaaagctgaatacaacccaaatgtctatgaactaatgaatagataaaccaaatctggtatatccatacaatggactatattattcagccataaaaagaaataaagggccaggcacagtggctcacacctgtaatcccagcactttgggaggctgaggcaggaggattgtttgaggccagaaatttgagaccagcctgggcaacatagcaaaaccctgtctctacaaaaaatactttccgtacattagtggttgcctaaggctagaattgggggtgatgaatggggagtacaggattcatctaatgggtacaggatttctttatggttcatgaaaatggtctaaacttattgtggtaatggtcacataacaatatattaaaaaccattgagttgtatattttaagtgggtgaattatatggtatgtgaattatatctcaataaagttgttagtaaataaatggggctgaagatgttatccttcattgtggtgtaaatgaactttcacaatattttcacctgtgaacccaaataaaatgattaaagttctgatggaaaaatcttgaatggagtataagttttccgttgttaaaaagcaaacaaaaaaccaacaaaaaatccaagtgtgccttgaattgtacagagcacaattattatgtttgaaatgtgtactacttaattttatataatttggtttgtgaaattaaagacatcaataaaaatgattcctgaaagtagtaa

SEQ ID NO: 9608 - DNA, 2577 bp, Homo sapiens
gaggtgccctcggtgatagaggaaacatggccgagtatacgcggctgcacaacgccttggcgctaatccgcctccgaaacccgccggtcaacgcgatcaggtaacgggctcggtcgcctccagcccggggaccgtgcgggccttagccgccctctggctccggaggctttgactctcccccgtcggtttaaaccgagaaggacactcaagagttgagcaactgtacgactttactccgtgacataaaagaaggactacagaaagctgtaatagaccatacaataaaagccattgtgatttgtggagcagagggcaaattttctgcaggtgctgatattcgtggcttcagtgctcctaggacatttggccttacactgggacatgtagtagatgaaatacagagaaatgagaagcccgtggtggcagcaatccaaggcatggctttcggagggggactagagctggccctgggctgtcactataggattgcccacgcagaggctcaagttggcttaccagaagttacactgggacttctccctggtgcaagaggaacccagcttctccccagactcactggagttcctgctgcacttgacttaattacctcaggaagacgtattttagcagatgaagcactcaagctgggcattctagataaagttgtaaactcagacccggttgaagaagcaatcagatttgctcagagagtttcagatcaacctctagaatcccgtagactctgcaacaagccaattcagagcttgcccaacatggacagcatttttagtgaggccctcttgaagatgcggaggcagcaccctgggtgtcttgcacaggaggcttgtgtccgtgcagtccaggctgctgtgcagtatccctatgaagtgggcatcaagaaggaggaggagctgtttctatatcttttgcaatcagggcaggctagagccctgcaatatgctttcttcgctgaaaggaaagcaaataagtggtcaactccctccggagcatcgtggaaaacagcatcagcgcggcctgtctcctcagttggtgttgttggcttgggaacaatgggccgaggcattgtcatttcttttgcaagggccaggattcctgtgattgctgtagactcggacaaaaaccagctagcaactgcaaacaagatgataacctctgtcttggaaaaagaagcctccaaaatgcaacagagcggccacccttggtcaggaccaaaacccaggttaacttcatctgtgaaggagcttggtggtgtagatttagtcattgaagcagtatttgaggaaatgagcctgaagaagcaggtctttgctgaactctcagctgtgtgcaaaccagaagcatttttgtgcactaatacttcagccctggatgttgatgagattgcttcttccactgatcgtcctcacttggtcattggcacccacttcttttcgccagctcatgtcatgaagttgttagaggttattcccagccaatactcttcccccactaccattgccactgttatgaacttatcaaaaaagattaaaaagattggagtcgttgtaggcaactgttttggatttgtggggaatcgaatgttgaatccttactacaatcaggcatatttcttgttagaagaaggcagcaaaccagaggaggtagatcaggtgctggaagagtttggttttaaaatgggaccttttagagtgtctgatcttgctgggttggatgtgggctggaaatctagaaaggggcaaggtcttactggacctacattgcttccaggaactcctgcccgaaaaaggggtaataggaggtactgcccaattcctgatgtgctctgtgaattaggacgatttggccagaagacaggtaagggttggtatcaatatgacaagccattgggtaggattcacaaacctgatccctggctttccaaattcctatcacggtatagaaaaacccatcacattgaaccacgtaccattagccaggatgagatccttgaacgctgcttatattcacttatcaatgaagcattccgtatcttgggagaagggatagctgctagcccagagcacattgatgttgtctatttacatggatatggatggccaaggcacaagggcgggcccatgttctatgcttccacagttgggttgcccacagttctagagaaattgcagaaatattacaggcagaaccctgatattccccaactggagccaagtgactatctaaaaaaactggcttctcagggaaaccctcccctgaaagaatggcaaagcttggcaggctcccctagcagtaaattgtgattcagtcttccagattatgcctcacatgctagcatcaggtaatgctgactgaatttcagtgaaattaaatcaaaaatccaaagtaagattgttctgaaatacaaagcaaaataaataatcattagaatcttctgtgtaacgactctaatggtcaaatctttaggaatgtgcttcctatgcctctgaatctgtccttatcagataaattcaatgcatgaacttgtgtgaatataataccataatagctaatgaaaga

SEQ ID NO: 9609 - DNA, 1537 bp, Homo sapiens
gaggaggccgggcgcgcccggaaaagtggtttgcctgacggcgagaggcagaggtgccctcggtgatagaggaaacatggccgagtatacgcggctgcacaacgccttggcgctaatccgcctccgaaacccgccggtcaacgcgatcagtacgactttactccgtgacataaaagaaggactacagaaagctgtaatagaccatacaataaaagccattgtgatttgtggagcagagggcaaattttctgcaggtgctgatattcgtggcttcagtgctcctaggacatttggccttacactgggacatgtagtagatgaaatacagagaaatgagaagcccgtggtggcagcaatccaaggcatggctttcggagggggactagagctggccctgggctgtcactataggattgcccacgcagaggctcaagttggcttaccagaagttacactgggacttctccctggtgcaagaggaacccagcttctccccagactcactggagttcctgctgcacttgacttaattacctcaggaagacgtattttagcagatgaagcactcaagctgggcattctagataaagttgtaaactcagacccggttgaagaagcaatcagatttgctcagagagtttcagatcaacctctagaatcccgtagactctgcaacaagccaattcagagcttgcccaacatggacagcatttttagtgaggccctcttgaagatgcggaggcagcaccctgggtgtcttgcacaggaggcttgtgtccgtgcagtccaggctgctgtgcagtatccctatgaagtgggcatcaagaaggaggaggagctgtttctatatcttttgcaatcagggcaggctagagccctgcaatatgctttcttcgctgaaaggaaagcaaataagtggtcaactccctccggagcatcgtggaaaacagcatcagcgcggcctgtctcctcagttggtgttgttggcttgggaacaatgggccgaggcattgtcatttcttttgcaagggccaggattcctgtgattgctgtagactcggacaaaaaccagctagcaactgcaaacaagatgataacctctgtcttggaaaaagaagcctccaaaatgcaacagagcggccacccttggtcaggaccaaaacccaggttaacttcatctgtgaaggagcttggtggtgtagatttagtcattgaagcagtatttgaggaaatgagcctgaagaagcaggtctttgctgaactctcagctgtgtgcaaaccagaagcatttttgtgcactaatacttcagccctggatgttgatgagattgcttcttccactgatcgtcctcacttggtcattggcacccacttcttttcgccagctcatgtcatgaagttgttagaggttattcccagccaatactcttcccccactaccattgccactgttatgaacttatcaaaaaagattaaaaagattggagtcgttgtaggcaactactctgtctcaaaaaaaaaaaaaaaaaaaaaaaag

SEQ ID NO: 9610 - DNA, 6587 bp, Homo sapiens
agtgtggccgttgtgggtgcatgcgcgtcaggcctgggacccggccgcccgcccgctgcctcacctgcaaggaggggcctcccagaaactcccttccccagtgcccagccgccccacctcgccagacttagctgaccagccagtgaggacgcccgctgcctcccacctgccctcctgccgtctttcgccagccaagcccagcctgagccagcacttgcctttacgaccatgttcaaggggctgagcaaaggctcccaggggaaggggtcccccaagggctcccccgccaaggggtcccccaaaggctcccccagcaggcacagccgggctgccacccaggagctggcccttctcatctcccgcatgcaagccaacgccgaccaggtggagcgggacatcctggagacgcagaagaggctgcagcaggaccggctgaacagtgagcagagccaggccctgcagcaccagcaggagacgggccgcagcctgaaggaggctgaggtgctgctcaaggacctcttcctggacgtggacaaggcccggcggctcaagcacccgcaggctgaggagattgagaaggacatcaagcagctgcacgagcgggtgacccaggagtgtgcggagtaccgtgccctgtacgagaagatggtgctgccccccgacgtgggacccagggtcgactgggcacgcgtgctggagcagaaacagaagcaggtctgcgcaggccagtacgggccgggcatggcggagctggagcaacagatcgccgagcacaacatcctgcagaaggagatcgacgcctatgggcagcagctgcggagcctcgtggggccggatgcagccaccatccggagccaataccgagacctactgaaggcggcgtcgtggcgcgggcagagcctgggcagcctgtacacgcacctccagggctgcacgcggcagctgagcgccctggctgagcagcagcgccgcatcctgcagcaggactggagcgacctcatggccgaccctgcgggcgtgcggcgggagtacgagcacttcaagcagcacgagctgctgagccaggagcagagcgtgaaccagctggaggacgacggcgagcgcatggtggagctgcggcaccccgcggtggggcccatccaggcccaccaggaggccctgaagatggagtggcagaacttcctgaacctgtgtatctgccaggagacccagctgcagcacgtggaggactaccgccggttccaggaagaggccgactcagtcagccagaccctggcgaagctcaactccaacttggatgccaagtacagccctgcacctgggggcccccctggcgcccccacagagctgctgcaacagctggaggcagaggaaaaacggctggccgtcaccgagagggccactggggacctgcagcggcgaagccgggatgtggcccctctgccacagcgaagaaacccccctcagcagcccctgcacgtggacagcatctgcgactgggactcaggagaagtgcagctgctgcagggtgagcggtataagctggtagataacactgacccgcacgcctgggtcgtgcagggccctggcggggagaccaagcgtgctcccgccgcctgcttctgcatcccagcaccagaccctgatgctgtggccagggcctcccggctggcctcagagctgcaggccctgaagcagaaattggccacagtccagagccgcctgaaggccagtgctgtggagtctcttcggcccagccagcaggctccatctggctcagacctggccaacccacaggcccagaagctcctgacacagatgacccggctggatggagacctgggacagatagagaggcaggtgctggcctgggcgcgggccccgctgagccgccccacacccttggaggacttggagggccgcatccacagccatgagggcacagcccagcgcctgcagagcctgggaacggagaaggagacagcccagaaggagtgcgaggcgtttctgtccacgcggcccgtgggccccgctgccctgcagctgcccgtagccctcaacagcgtgaagaacaagttcagtgacgtgcaggttctgtgcagcctctacggggagaaagccaaggctgccctggatctggagcggcagatccaggatgcggacagggtcatccgaggcttcgaggccaccctggtgcaggaggcccccatccctgctgaaccgggggctctgcaggagagggtcagcgagctgcagcgccagcggagggagctgctggaacagcagacctgcgtgctgcggctacaccgcgcgctgaaggcctcggagcacgcatgcgctgccctgcagaacaacttccaggagttctgccaagacctgcctcgccagcagcgccaggtgcgagccctcaccgaccgctaccacgccgtaggggaccagctggacctgcgggagaaggtggtgcaggatgccgccctcacctaccagcagttcaagaactgcaaggataacctgagctcctggctggagcacctgccccgcagccaggtgcggcccagcgacggccccagccagatcgcctacaagctgcaggcgcagaagaggctgacgcaggagatccagagccgagagcgggacagggccacagcatcccacctctcccaggccctgcaggcagcgctccaggactatgagctccaggcagacacctaccgctgctctttggagcccaccctggcagtgtcagcccccaagagaccccgagtggctcccctgcaagagagcatccaagcccaggagaagaaccttgcaaaggcctatactgaggttgcagcagcacagcagcagctgctccagcagctggagtttgctagaaaaatgctggagaagaaggagctcagtgaggacatccgaaggacccatgatgcaaagcagggctccgagagccctgcccaagcagggagagagtcagaggccctgaaggcccagctggaagaggagaggaagcgggtggcccgggtgcagcatgagctggaggcgcagaggagccaactgctgcagctgaggacccagcggcccttggagaggctggaggagaaggaagtggtagagttctaccgggacccccagctggagggcagcctgtccagggtgaaggcccaggtggaggaggagggcaagcggcgggctggcctgcaggcagacctggaagtggcagcccagaaggtcgtgcagctggaaagcaagaggaagaccatgcagcctcatctgctgaccaaggaggtcacccaggtggagagggaccccggcctggacagccaggcggcccagctcaggatccagatccagcagctccgcggggaggatgccgtcatctcggcccggctggaagggctgaagaaggagctactggcccttgagaagagggaggtggacgtgaaggagaaggtcgtggtgaaagaggtagtcaaggtggagaagaatctggaaatggtcaaggcagcccaggctctgaggctgcagatggaggaggatgctgcgcggaggaagcaggcggaggaggctgtggccaagctacaggctcgcatcgaagacctggagcgggctatcagctcggtggagcccaaggtcatcgtgaaggaggtgaagaaggtggagcaggacccagggctcctccaggagtcctccaggctgaggagcctcctcgaggaggagaggaccaagaacgcgacgctggccagggagctgagcgacctgcacagcaagtacagcgtggtggagaagcagaggcccaaagtgcagctccaggagcgcgtccacgagatcttccaggtggatccggagacagagcaggagatcactcggctcaaggccaagctgcaggagatggcgggcaagaggagcggtgtggagaaggaggtggagaagctgctgcccgacctggaggtcctgcgggcccagaagcccacggtggagtacaaggaggtgacccaggaggtggtgaggcatgagaggagccccgaggtgctgcgtgagatcgaccgcctgaaggctcagctcaacgagctcgtcaacagccacgggcgctcccaggagcagctcatccgcctgcagggtgagcgcgacgagtggaggcgcgagcgggccaaggtggagaccaagacggtgagcaaggaggtggtgcgccacgagaaggacccggtgctggagaaagaagcagagcggctccgccaggaggtgcgggaggcggcccagaagaggcgggccgcggaggacgcggtgtacgagctgcagagcaagcgcctgctgctggagaggaggaagcccgaggagaaggtggtggtgcaggaggtggtggtcacccagaaggacccgaagctgcgcgaggagcacagccggctgagcgggagcctggatgaggaggtgggccggcggcgccagctagagcttgaggtgcagcagctgcgggccggcgtggaggagcaggagggcctgctcagcttccaggaggaccgcagcaagaagctggccgtggagagggagctgcggcagctgaccttgaggatccaggagctcgagaagcggcctcccacggtgcaggagaagatcatcatggaggaagtggtcaagctggagaaggacccggacctggagaagtccacggaagccctgcggtgggacctggaccaggagaagacccaggtaaccgagctgaatcgggagtgcaagaacctgcaggtccagattgacgtcctccagaaagccaaatcgcaggagaagaccatctacaaggaagtgatccgggtgcagaaggaccgcgtcctggaagatgagcgggcccgcgtgtgggagatgctcaacagggagcgcacggcccggcaggcccgggaggaggaggcacggcgcctgcgggagcgcattgaccgggccgagacgctggggagaacctggtcccgggaggagtccgagctgcagagggcccgggaccaggccgaccaggagtgtgggcggctgcagcaggagctgcgggctctggagaggcagaagcagcagcagacactgcagctgcaggaggagtcgaagctgctcagccagaagacggagagcgagcgacagaaggcggcccagcggggccaggagctctcgcggctggaggcggccatcctccgcgagaaggaccagatctacgagaaggagcggacgctccgggacctccacgccaaggtgagccgggaggagctcagccaggagacccagacgcgagagaccaacctttccaccaagatctccatcctggaacccgagacggggaaggacatgtccccatacgaggcctacaagaggggcatcatcgacaggggccagtacttgcagctgcaggagctcgagtgtgactgggaggaggtcaccacctcggggccctgtggggaggagtctgtgctcctggaccgcaagagcgggaagcagtactccatcgaggccgccctccgctgccggcgcatctctaaggaggagtaccatctgtacaaggacggccacctgcccatctccgagtttgcgctgcttgtagctggggagaccaagccaagctcctcactctccatcggctctatcatctccaagtccccgctcgcctccccggccccccagagcaccagtttcttctctcccagcttctctctcgggctcggtgatgacagcttccctatcgccgggatctatgacacaaccacagacaacaagtgcagcatcaagacggccgtggccaagaacatgctggaccccatcactgggcagaagctactggaggcccaggcggccacagggggcatcgtggacctgctcagccgtgagcgctactctgtgcacaaggcgatggagaggggcctgatcgagaacacctccacacagaggctgcttaacgcccagaaggccttcaccggcatcgaggaccccgtcaccaagaagaggctctcggtgggcgaggccgtccagaagggctggatgccccgggagagcgtgctcccacacctgcaggtgcagcacctgaccggggggctcatcgaccccaagaggacaggccgcatccccatccagcaggccctcctctccgggatgatcagtgaagagctggcccagctcctgcaggacgagtccagctacgagaaggatttgacagaccccatctccaaggaacggctgagctacaaggaggccatgggccgctgccgcaaagaccccctgagcggcctgctgctcctgccagcggcactggaggggtaccgctgctaccgctccgcctcccccaccgtcccgcgctcccttcgctgacacgggccaaggagccagtggggaagtgcgtgtgttgggccaggtaggatacgtacacctcttgcctcagagcagcctcatcccaggcagtgggtcttccctctgtccaaccactgttttattattttactaacatggtgatgggctccctcccctaaccttggtgcctgatccatccccagaccaggacagcagccactcagttcttcctccacctccacccagtgatcccaataaacgaattctgtctccccgtg

SEQ ID NO: 9611 - DNA, 3386 bp, Homo sapiens
tttccttccggaaaggacgctggattcagggcgcgccagtacgcgcagtagcggcccgcgagtcggcaggtgggtagccccggcgcgggaggaaggggaagttaccttcccctcggaagagggcgctggctcccccatcctgcctttataataaggccaccggaggagaggaagcagccagctgccgtctgcgctttgcaaagcatgcagttaggggagcagctcttggtgagctcagtgaacctgcctggcgcgcacttctacccgctggagagtgcgcgaggcggcagcggcgggagcgctggccacctccccagcgcggccccctctcctcagaagttggacttagacaaagcgtccaagaagttttccggcagtctctcctgcgaggcggtgagcggggagcccgcagccgccagcgcaggggcccccgcggccatgcttagtgacaccgacgccggggacgcatttgccagcgctgcggcagtggccaagccggggcccccggacggccgcaagggctccccctgcggggaggaggagctgccctccgccgctgcagccgccgccgccgccgccgccgcggctgcggccactgcgcgctactccatggacagcctgagctccgagcggtactacctccagtcccccggtcctcaggggtcggagctggctgcgccctgctcactcttcccgtaccaggcggcggctggggcgccccacggacctgtgtacccggctcctaacggggcgcgctacccctacggctccatgctgccccccggcggcttccccgcggctgtgtgcccacccgggagggcgcagttcggcccaggagccggtgcgggcagtggcgcgggcggtagcagcggcgggggcggcggcccgggcacctatcagtacagccagggggctccgctctacgggccgtaccctggagccgcagcggcgggatcttgcggaggactggggggcctgggggttccaggttctggcttccgtgcccacgtctacctgtgcaaccggcctctgtggctcaaattccaccgccaccaaactgagatgatcattacgaaacagggcaggcgcatgtttcctttcttgagcttcaacataaacggactcaatcccactgcccactacaatgtgttcgtagaggtggtgctggcggaccccaaccactggcgcttccaggggggcaaatgggtgacctgtggcaaagccgacaataacatgcagggcaacaaaatgtatgttcacccagagtctcctaatactggttcccactggatgagacaggagatttcattcgggaaattaaaactcaccaataacaaaggcgcaaataacaacaacacccagatgatagtcttacaatccttacacaaataccaaccccgactgcatattgttgaagttacagaggatggcgtggaggacttgaatgagccctcaaagacccagacttttaccttctcagaaacgcaattcattgcagtgactgcctaccaaaacaccgatattactcaactaaagattgatcataacccctttgcaaaaggcttcagagacaactatgattcatcccatcagattgtccctggaggtcggtacggcgttcaatccttcttcccggagccctttgtcaacactttacctcaagcccgctattataatggcgagagaaccgtgccacagaccaacggcctcctttcaccccaacagagcgaagaggtggccaaccctccccagcggtggcttgtcacgcctgtccagcaacctgggaccaacaaactagacatcagttcctatgaatctgaatatacttctagcacattgctcccatatggcattaaatccttgccccttcagacatcccatgccctggggtattacccagacccaacctttcctgcaatggcagggtggggaggtcgaggttcttaccagaggaagatggcagctggactaccatggacctccagaacaagccccactgtgttctctgaagatcagctctccaaggagaaagtgaaagaggaaattggctcttcttggatagagacacccccttccatcaaatctctagattccaatgattcaggagtatacaccagtgcttgtaagcgaaggcggctgtctcctagcaactccagtaatgaaaattcaccctccataaagtgtgaggacattaatgctgaagagtatagtaaagacacctcaaaaggcatgggagggtattatgctttttacacaactccctaaagagttattttaacctcaaaaattagctaactttttgcagatggacttggtggtgttttttgttgtcttctttgcctaggttgccaaaaagatgtttgccttccaccttgatgcatcctgttttgtgcaattctctaaaagaaggtgccaaagctttttgattgctgcaggtaactgaaacaaacctagcatttttaaaaaataagattaatggaagactttaaggtattttaaaattcgaagggtatccaaggttctgtatttatttattggggagacactaacccttcaaagaagcaggctgtgaacattgggtgcccagtgctatcagatgagttaaaacctttgattctcatttctatttgtaaattcttaagcaaatagaagccgagtgttaaggtgttttgcttctgaaagagggctgtgccttccgtttcagaaggagacattttgctgttacattctgccaggggcaaaagatactaggcccaggagtcaagaaaagcttttgtgaaagtgatagtttcacctgactttgattccttaacccccggcttttggaacaagccatgtttgccctagtccaggattgcctcacttgagacttgctaggcctctgctgtgtgctggggtggccagtgggactcaggagagagcaagctaaggagtcaccaaaaaaaaaaaaaaaaaaaagggagaatttaaaagtgtacagttgtgtgtttagatacactatagaataatgtggtatatattgtacaaatagtctacataggtgtctgggataatgtaaaactggtgctttggctttgtaaagaatttgcaaatcacttaacagctgcaggggcaaggggagagtttcatcatccccatgatatttgggaatattctgtttacttcttagatagttaagaatgtattcagctactatgtactaacttgaaccgtgtttaaggaaaactcctatttcatcctcttcttgcgccatcccctctccctaacttggtaatgtgaagaaactaaaacctgataccacagctcctataggcattttagagatcttggatttttatgtacagtcttagtcatttttaataaatgtggttcagtaagggaacgga

SEQ ID NO: 9612 - DNA, 2829 bp, Homo sapiens
gtctgcgctttgcaaagcatgcagttaggggagcagctcttggtgagctcagtgaacctgcctggcgcgcacttctacccgctggagagtgcgcgaggcggcagcggcgggagcgctggccacctccccagcgcggccccctctcctcagaagttggacttagacaaagcgtccaagaagttttccggcagtctctcctgcgaggcggtgagcggggagcccgcagccgccagcgcaggggcccccgcggccatgcttagtgacaccgacgccggggacgcatttgccagcgctgcggcagtggccaagccggggcccccggacggccgcaagggctccccctgcggggaggaggagctgccctccgccgctgcagccgccgccgccgccgccgccgcggctgcggccactgcgcgctactccatggacagcctgagctccgagcggtactacctccagtcccccggtcctcaggggtcggagctggctgcgccctgctcactcttcccgtaccaggcggcggctggggcgccccacggacctgtgtacccggctcctaacggggcgcgctacccctacggctccatgctgccccccggcggcttccccgcggctgtgtgcccacccgggagggcgcagttcggcccaggagccggtgcgggcagtggcgcgggcggtagcagcggcgggggcggcggcccgggcacctatcagtacagccagggggctccgctctacgggccgtaccctggagccgcagcggcgggatcttgcggaggactggggggcctgggggttccaggttctggcttccgtgcccacgtctacctgtgcaaccggcctctgtggctcaaattccaccgccaccaaactgagatgatcattacgaaacagggcaggcgcatgtttcctttcttgagcttcaacataaacggactcaatcccactgcccactacaatgtgttcgtagaggtggtgctggcggaccccaaccactggcgcttccaggggggcaaatgggtgacctgtggcaaagccgacaataacatgcagggcaacaaaatgtatgttcacccagagtctcctaatactggttcccactggatgagacaggagatttcattcgggaaattaaaactcaccaataacaaaggcgcaaataacaacaacacccagatgatagtcttacaatccttacacaaataccaaccccgactgcatattgttgaagttacagaggatggcgtggaggacttgaatgagccctcaaagacccagacttttaccttctcagaaacgcaattcattgcagtgactgcctaccaaaacaccgatattactcaactaaagattgatcataacccctttgcaaaaggcttcagagacaactatgattccatgtacaccgcttcagaaaatgacaggttaactccatctcccacggattctcctagatcccatcagattgtccctggaggtcggtacggcgttcaatccttcttcccggagccctttgtcaacactttacctcaagcccgctattataatggcgagagaaccgtgccacagaccaacggcctcctttcaccccaacagagcgaagaggtggccaaccctccccagcggtggcttgtcacgcctgtccagcaacctgggaccaacaaactagacatcagttcctatgaatctgaatatacttctagcacattgctcccatatggcattaaatccttgccccttcagacatcccatgccctggggtattacccagacccaacctttcctgcaatggcagggtggggaggtcgaggttcttaccagaggaagatggcagctggactaccatggacctccagaacaagccccactgtgttctctgaagatcagctctccaaggagaaagtgaaagaggaaattggctcttcttggatagagacacccccttccatcaaatctctagattccaatgattcaggagtatacaccagtgcttgtaagcgaaggcggctgtctcctagcaactccagtaatgaaaattcaccctccataaagtgtgaggacattaatgctgaagagtatagtaaagacacctcaaaaggcatgggagggtattatgctttttacacaactccctaaagagttattttaacctcaaaaattagctaactttttgcagatggacttggtggtgttttttgttgtcttctttgcctaggttgccaaaaagatgtttgccttccaccttgatgcatcctgttttgtgcaattctctaaaagaaggtgccaaagctttttgattgctgcaggtaactgaaacaaacctagcatttttaaaaaataagattaatggaagactttaaggtattttaaaattcgaagggtatccaaggttctgtatttatttattggggagacactaacccttcaaagaagcaggctgtgaacattgggtgcccagtgctatcagatgagttaaaacctttgattctcatttctatttgtaaattcttaagcaaatagaagccgagtgttaaggtgttttgcttctgaaagagggctgtgccttccgtttcagaaggagacattttgctgttacattctgccaggggcaaaagatactaggcccaggagtcaagaaaagcttttgtgaaagtgatagtttcacctgactttgattccttaacccccggcttttggaacaagccatgtttgccctagtccaggattgcctcacttgagacttgctaggcctctgctgtgtgctggggtggccagtgggactcaggagagagcaagctaaggagtcaccaaaaaaaaaaaaaaaaaaaa

SEQ ID NO: 9613 - DNA, 2354 bp, Homo sapiens
aagtggtcaacttgaccgatgctttggcaattgaaaaagggcagaaaggcgcgggctagtgggtggatggggacaaagatctaagtcaccttcttccagcgtgtgagcctgggaggagggtgggggtcctgaggagctgccctccgccgctgcagccgccgccgccgccgccgccgcggctgcggccactgcgcgctactccatggacagcctgagctccgagcggtactacctccagtcccccggtcctcaggggtcggagctggctgcgccctgctcactcttcccgtaccaggcggcggctggggcgccccacggacctgtgtacccggctcctaacggggcgcgctacccctacggctccatgctgccccccggcggcttccccgcggctgtgtgcccacccgggagggcgcagttcggcccaggagccggtgcgggcagtggcgcgggcggtagcagcggcgggggcggcggcccgggcacctatcagtacagccagggggctccgctctacgggccgtaccctggagccgcagcggcgggatcttgcggaggactggggggcctgggggttccaggttctggcttccgtgcccacgtctacctgtgcaaccggcctctgtggctcaaattccaccgccaccaaactgagatgatcattacgaaacagggcaggcgcatgtttcctttcttgagcttcaacataaacggactcaatcccactgcccactacaatgtgttcgtagaggtggtgctggcggaccccaaccactggcgcttccaggggggcaaatgggtgacctgtggcaaagccgacaataacatgcagggcaacaaaatgtatgttcacccagagtctcctaatactggttcccactggatgagacaggagatttcattcgggaaattaaaactcaccaataacaaaggcgcaaataacaacaacacccagatgatagtcttacaatccttacacaaataccaaccccgactgcatattgttgaagttacagaggatggcgtggaggacttgaatgagccctcaaagacccagacttttaccttctcagaaacgcaattcattgcagtgactgcctaccaaaacaccgatattactcaactaaagattgatcataacccctttgcaaaaggcttcagagacaactatgattccatgtacaccgcttcagaaaatgacaggttaactccatctcccacggattctcctagatcccatcagattgtccctggaggtcggtacggcgttcaatccttcttcccggagccctttgtcaacactttacctcaagcccgctattataatggcgagagaaccgtgccacagaccaacggcctcctttcaccccaacagagcgaagaggtggccaaccctccccagcggtggcttgtcacgcctgtccagcaacctgggaccaacaaactagacatcagttcctatgaatctgaatatacttctagcacattgctcccatatggcattaaatccttgccccttcagacatcccatgccctggggtattacccagacccaacctttcctgcaatggcagggtggggaggtcgaggttcttaccagaggaagatggcagctggactaccatggacctccagaacaagccccactgtgttctctgaagatcagctctccaaggagaaagtgaaagaggaaattggctcttcttggatagagacacccccttccatcaaatctctagattccaatgattcaggagtatacaccagtgcttgtaagcgaaggcggctgtctcctagcaactccagtaatgaaaattcaccctccataaagtgtgaggacattaatgctgaagagtatagtaaagacacctcaaaaggcatgggagggtattatgctttttacacaactccctaaagagttattttaacctcaaaaattagctaactttttgcagatggacttggtggtgttttttgttgtcttctttgcctaggttgccaaaaagatgtttgccttccaccttgatgcatcctgttttgtgcaattctctaaaagaaggtgccaaagctttttgattgctgcaggtaactgaaacaaacctagcatttttaaaaaataagattaatggaagactttaaggtattttaaaattcgaagggtatccaaggttctgtatttatttattggggagacactaacccttcaaagaagcaggctgtgaacattgggtgcccagtgctatcagatgagttaaaacctttgattctcatttctatttgtaaattcttaagcaaatagaagccgagtgttaaggtgttttgcttctgaaagagggctgtgccttccgtttcag

SEQ ID NO: 9614 - DNA, 2084 bp, Homo sapiens
aagtttccaagtggtcaacttgaccgatgctttggcaattgaaaaagggcagaaaggcgcgggctagtgggtggatggggacaaagatctaagtcaccttcttccagcgtgtgagcctgggaggagggtgggggtcctgaggagcaagaggtacgaggaaggaaaaggagagggcttctgggttagtttccacctcctgctttccaactcacggcgctttccttccggaaaggacgctggattcagggcgcgccagtacgcgcagtagcggcccgcgagtcggcaggcgcatgtttcctttcttgagcttcaacataaacggactcaatcccactgcccactacaatgtgttcgtagaggtggtgctggcggaccccaaccactggcgcttccaggggggcaaatgggtgacctgtggcaaagccgacaataacatgcagggcaacaaaatgtatgttcacccagagtctcctaatactggttcccactggatgagacaggagatttcattcgggaaattaaaactcaccaataacaaaggcgcaaataacaacaacacccagatgatagtcttacaatccttacacaaataccaaccccgactgcatattgttgaagttacagaggatggcgtggaggacttgaatgagccctcaaagacccagacttttaccttctcagaaacgcaattcattgcagtgactgcctaccaaaacaccgatattactcaactaaagattgatcataacccctttgcaaaaggcttcagagacaactatgattccatgtacaccgcttcagaaaatgacaggttaactccatctcccacggattctcctagatcccatcagattgtccctggaggtcggtacggcgttcaatccttcttcccggagccctttgtcaacactttacctcaagcccgctattataatggcgagagaaccgtgccacagaccaacggcctcctttcaccccaacagagcgaagaggtggccaaccctccccagcggtggcttgtcacgcctgtccagcaacctgggaccaacaaactagacatcagttcctatgaatctgaatatacttctagcacattgctcccatatggcattaaatccttgccccttcagacatcccatgccctggggtattacccagacccaacctttcctgcaatggcagggtggggaggtcgaggttcttaccagaggaagatggcagctggactaccatggacctccagaacaagccccactgtgttctctgaagatcagctctccaaggagaaagtgaaagaggaaattggctcttcttggatagagacacccccttccatcaaatctctagattccaatgattcaggagtatacaccagtgcttgtaagcgaaggcggctgtctcctagcaactccagtaatgaaaattcaccctccataaagtgtgaggacattaatgctgaagagtatagtaaagacacctcaaaaggcatgggagggtattatgctttttacacaactccctaaagagttattttaacctcaaaaattagctaactttttgcagatggacttggtggtgttttttgttgtcttctttgcctaggttgccaaaaagatgtttgccttccaccttgatgcatcctgttttgtgcaattctctaaaagaaggtgccaaagctttttgattgctgcaggtaactgaaacaaacctagcatttttaaaaaataagattaatggaagactttaaggtattttaaaattcgaagggtatccaaggttctgtatttatttattggggagacactaacccttcaaagaagcaggctgtgaacattgggtgcccagtgctatcagatgagttaaaacctttgattctcatttctatttgtaaattcttaagcaaatagaagccgagtgttaaggtgttttgcttctgaaagagggctgtgccttccgtttcagaaggagacattttgctgttacattctgccaggggcaaaagatactaggcccaggagtcaagaaaagcttttgtgaaagtgatagtttcacctgactttgattccttaacccccggcttttgg

SEQ ID NO: 9615 - DNA, 2716 bp, Homo sapiens
agagctggaggaagtgagaggtcggctgggggtcctcaaagtgagaggggagcagaggatcctcccgtgcaggctgtggatgtcactcacttcccagctggtgaagcctcgctgcagagatgcatctgctcccagccctggcaggggtcctggccacactcgtcctcgcccagccctgtgagggcactgacccagcctcccctggggcagtggagacctcggtcctgcgagactgcatagcagaggccaagttgctggtggatgctgcctacaattggacccagaagagcatcaagcagcggcttcgcagcggttcagccagccccatggacctcctgtcctacttcaaacaaccggtagcagccaccaggacagttgttcgggccgcagattatatgcatgtggctttggggctgcttgaagagaagttacaaccccagcggtccggacccttcaatgtcactgatgtgctaacagaaccacagctgcggctgctgtcccaggccagtggctgtgctctccgggaccaggccgagcgctgcagcgacaagtaccgcaccatcactggacggtgcaacaacaagaggagacccttgctaggggcctccaaccaggctctggctcgctggctgcccgccgagtatgaggatgggctgtcgctccccttcggctggacccccagcaggaggcgcaatggcttccttctccctcttgtccgggctgtctccaaccagattgtgcgcttccccaatgagagactgacctccgaccgtggccgagccctcatgttcatgcagtggggccagttcattgaccatgacctggacttctccccggagtccccggccagagtggccttcactgcaggcgttgactgtgagaggacctgcgcccagctgcccccctgctttcccatcaagatcccacccaatgacccccgcatcaagaaccagcgtgactgcatccctttcttccgctcggcaccctcatgcccccaaaacaagaacagagtccgcaaccagatcaacgcgctcacctcctttgtggacgccagcatggtgtatggcagtgaggtctccctctcgctgcggctccgcaaccggaccaactacctggggctgctggccatcaaccagcgctttcaagacaacggccgggccctgctgcccttcgacaacctgcacgatgacccctgtctcctcaccaaccgctcggcgcgcatcccctgcttcctggcaggtgacacccgatcaacggaaacccccaaactggcagccatgcacaccctctttatgcgagagcacaaccggctggccaccgagctgagacgcctgaatccccggtggaatggagacaaactgtacaatgaggctcggaagatcatgggggccatggtccagatcatcacctaccgagactttctgcccctggttctgggcaaggcccgggccaggagaaccctggggcactacagggggtactgctccaatgtggacccacgggtggccaatgtcttcaccctggccttccgctttggccacacaatgctccagcccttcatgttccgcttggacagtcagtaccgggcctccgcacccaactcgcatgtcccacttagctctgccttctttgccagctggcggatcgtgtatgaagggggcatcgaccccatcctccggggcctcatggccacccctgccaagctgaaccgtcaggatgccatgttagtggatgagctccgggaccggctgtttcggcaagtgaggaggattgggctggacctggcagctctcaacatgcaacgaagccgggaccacggccttccagggtacaatgcttggaggcgcttctgtgggctctcccagccccggaatttggcacagcttagccgggtgctgaaaaaccaggacttggcaaggaagttcctgaatttgtatggaacacctgacaacattgacatctggattggggccatcgctgagcctcttttgccgggggctcgagtggggcctcttctggcttgtctgttcgagaaccagttcagaagagcccgagacggagacaggttctggtggcagaaacgaggtgttttcaccaaaagacagcgcaaggccctgagcagaatttccttgtctcgaattatatgtgacaataccggtatcaccacggtttcaagggacatcttcagagccaacatctaccctcggggctttgtgaactgcagccgtatccccaggttgaacctatcagcctggcgagggacatgaggcttctgcaggagtctatcccaagtctccaacttttggagacaaggggaaggggaggaccatgaggctgccttgtctccctggagcaagtgcaggctgctgacgcttctgctggctacagctcagagctgggttccccagccaggagtgaaggctgggggctcctatcagcaatggaccttcccgccttgggagcctcttaggtattaggctatgaatcagcgccacgtgcaaaggcttgggagccaagccatgtggtcttgcaccccaggcaagaaaagtcagctggagggtttacagcactttctactgtttcccagccctccctcccctccctcaccatgactaagagaccactcggtcctagcctccagacaccccacaatactcctctgagcctgaggccaggcagcatgctctgcttctaccaataaagcactgctaagggc

SEQ ID NO: 9616 - DNA, 2298 bp, Homo sapiens
agcagcagtagggttaagtaacacagaaactgttacgctcttgcatgcagggtccctagatacgaagttcgaatcgatggaaacgtagctcaaaaggcgacgccaacaccccggagaaaacactgagctactccaaccacagtggcgcgccaagtaggaggcggtacctgaggaccacgcctgcgcgcggggttacgcaagcgcgcagcctttgcgcacgcgcacgaacgcacggccgcgcagcatctgtcttgctggaagctttttcctagaggttgagcggtttgcacaatgtcggaaatggctgagttgtccgagctgtatgaagagagcagtgacctgcagatggatgtgatgcctggcgagggtgaccttccgcagatggaggtaggcagcgggagccgggagctatccctgcgtccctcccgcagcggggcccaacagctcgaggaggaaggcccaatggaggaggaggaggcccagccaatggcggcgccagaggggaaacggagccttgctaacgggcccaacgctggggagcagccaggccaggtggcgggcgcagacttcgagagcgaggacgagggcgaggaatttgatgactgggaggacgactacgactatcccgaagaggagcagctcagtggtgccggctacagagtatcagccgctcttgaagaagccgacaagatgtttctgagaacaagagaaccagccctggatggcgggtttcagatgcattatgagaagaccccgtttgatcagttagcttttatcgaagagcttttttcactgatggttgtcaatcgtctgaccgaagaactcggctgtgatgagattattgatagagagtagttagatgctgttaaaagaggaggaaactacttgaggagggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgtattttgtttggctaatagtattgcatacatactttctctgtatactactttctattgtatgtgttaaccagtattaagggaaaatgatccagcttcagctatctaattcacaaattaatttctggaaattaaactttgtaaattaagtttttgcctataagaatttgctggtctgggaaaacctgccctatcaatgagtatgttgccgtggttaccttactaagatgctgaagttctaggagagtaatgattacatcagaaggctaggttcagcaaaataagtgtatcagcaggttttatcatgatcagtaaaaatgttccaaatgcttctgctccattatagcagtaaagaacgaatatccaatgcaacaggacaatt

SEQ ID NO: 9617 - DNA, 1981 bp, Homo sapiens
gtaagaatctatgctctcgcgcccggttacgcacactgcatttacagcgcgcatagcgcccacgcacgcgcactggggtgtccgccgggcatcgctctgtccagttattccagtttctctgggagcagccgagttgaccccacggtctgagatgtccaagctgcccgcagacagcagtgtcccgcagacaggcgcggcgaatggtgacagagacgtcccgcaggcggaggtaggccgcgggaggcgggagccggccccggcacagcctgaggaggccggggaaggcgcgatggcggcggccaggggaggcccggtgccggcggccagggaaggtcggatggcggcggccagggcagccccggcggcggcagccaggggagccccggtggcagcggcggcgttggccagggcagccgcggcgggcagggaaagcccggcggcggcggcggccagggaagcccggatggcggaggtcgcccgcttgctgggggagccagtggacgaagagggtcccgagggcaggcccaggtccagacacgggaacggaggcctggctgcgttgccctatctccgtctccgccacccacttagcgttttaggcatcaattaccagcagtttctccgccactatctggaaaattacccgattgctcccggcagaatacaagagcttgaagaacgccgcaggcgattcgtggaagcctgcagagcaagggaagcagcgtttgatgccgaatatcagcgaaatcctcacagggtggacctcgatattttaacctttacgatagctctgactgcctctgaagttatcaaccctctgatagaagaacttggttgcgataagtttatcaatagagaatagttatgtggtgacactacttcaagagaacctctgcattccagtcataccaatcctgcaacttgattttcagaagtcaagagtatatcgcgataagacagtgcacaggtggaggggaaaaaaagggggagggggaagcttatcttgaaaaagcatcacagaagtagaaaaaaatgtcgaaagcattataactgtaacgttctttgagtttgtgattgatccacatttttccccctgcattatggaaaatgtctctcagcattgctttattacaaagtaaaggatggttttataaaattgagactgatgaaacatcaatactagagcccatgaggatgaaagaaattatcaaatagtgctgaacagaataagatgttaacgctgagttattaggactggaaggctatgaaaagaacttgaaattgtcggaatatgtgctctcttcatgtcatattcaatagaagtttctagtttaagattgattttgtgttttcttaggcatttcaagtgacaagcaaagtaaatgtatatattatgtgataaatcatgttttcaagaacgtcaaatttctggacttttttctttcaatttttaatttttaaagtttttttggtattaaaaaatctattcacaagccaaaaaatatataaaatatacagcgaaaagccttccattcttgttttcctccatccagtaccaacgatgacctctaatagccacagtttcctttccgtccttctagtttccttacgtgtacacaggcacatataaatctgggtttacttgttttatttcttcacagaagtcggcatattatatttactggtttatacattgctttctcattaagaacatatgttgacccttccaaaccactgtatttcctcattattttttaaagtggcattttattccattctgaggttatgtccaaatttacttaaccagggatatattgacggacatttaggttgtttcccatctctttctttgggcagaataaaaaattgctagagtagttcatcttgtacaattgctagagtagttcatcttgtatatcatgtggcatgtgcacaaatatagtattgcttcaattcaaaattcacttcatatttgaacatc

SEQ ID NO: 9618 - DNA, 1243 bp, Homo sapiens
acactgcatttacagcgcgcatagcgcccacgcacgcgcactggggtgtccgccgggcatcgctctgtccagttattccagtttctctgggagcagccgagttgaccccacggtctgagatgtccaagctgcccgcagacagcagtgtcccgcagacaggcgcggcgaatggtgacagagacgtcccgcaggcggaggtaggccgcgggaggcgggagccggccccggcacagcctgaggaggccggggaaagcccggcggcggcggcggccagggaagcccggatggcggaggtcgcccgcttgctgggggagccagtggacgaagagggtcccgagggcaggcccaggtccagacacgggaacggaggcctggctgcgttgccctatctccgtctccgccacccacttagcgttttaggcatcaattaccagcagtttctccgccactatctggaaaattacccgattgctcccggcagaatacaagagcttgaagaacgccgcaggcgattcgtggaagcctgcagagcaagggaagcagcgtttgatgccgaatatcagcgaaatcctcacagggtggacctcgatattttaacctttacgatagctctgactgcctctgaagttatcaaccctctgatagaagaacttggttgcgataagtttatcaatagagaatagttatgtggtgacactacttcaagagaacctctgcattccagtcataccaatcctgcaacttgattttcagaagtcaagagtatatcgcgataagacagtgcacaggtggaggggaaaaaaagggggagggggaagcttatcttgaaaaagcatcacagaagtagaaaaaaatgtcgaaagcattataactgtaacgttctttgagtttgtgattgatccacatttttccccctgcattatggaaaatgtctctcagcattgctttattacaaagtaaaggatggttttataaaattgagactgatgaaacatcaatactagagcccatgaggatgaaagaaattatcaaatagtgctgaacagaataagatgttaacgctgagttattaggactggaaggctatgaaaagaacttgaaattgtcggaatatgtgctctcttcatgtcatattcaatagaagtttctagtttaagattgattttgtgttttcttaggcatttcaagtgacaagcaaagtaaatgtatatattatgtgataaatcatgttttcaagaacgtc

SEQ ID NO: 9619 - DNA, 1464 bp, Homo sapiens
atgggcgggcgtcctcggctctaactgccgccactttccacacgctgggagggccgttacctcagagatacccgtggccggcatgttggttgaaaaagcttcccggaagggagacgaagagaaaggagaggagcagctcgtgatcatccccggtagcgagtacgcggcgaagtaggcggcggcggagggagcgctgatgaagatggatgtgtcagtgagggccgcgggctgctccgacgacctcagctctggggaggccgacgtagacccaaagctcctggagctcaccgctgacgaggagaagtgccgcagcatccgcaggcagtaccggcagctcatgtactgcgtgcggcagaaccgggaggacatcgtgagctcggcgaacaactccttaaccgaggctctggaggaagccaacgtcctctttgatggcgtgagccgaaccagagaagcagccctcgacgcccggtttcttgttatggcttctgatttgggtaaagaaaaggcaaagcagttaaactcagatatgaacttctttaatcagttagcattttgtgactttctgtttctgttcgtgggtctgaattggatggaaggcgatcctgacaagttgagtgattgtgatgatagcatagctctttccttctggaaggcaatagaaaaggaagcaacatcctggatggtaaaagctgagacattccattttgtttttggttcattcaagctagaacgttctgcaccaaagccccgacttgaacaccagaaaaaagttcgcaagatggaagaaaatggcaacatgcctacaaagttgcagaagttggacctgagtagttatccagaagcgacagaaaaaaacgtagaaaggattttgggattgttgcaaacctactttcgaaagtatcctgatactcctgtgtcctattttgagtttgtgattgatccaaactctttttctcgtactgtggagaatatattttatgtttcttttattgtaagagatggttttgcaagaataaggcttgatgaagacaggctgccaatattagagccgatgaatgttaaccaaatgggtgagggaaatgattccagttgccatggcaggaaacagggagttatatctttgactttacaggagtggaaaaacattgtggcagcttttgaaatttctgaggctatgattacatactcctcatactaaagatttcttagtatagcatcctttttgtgttttttttctgaagttagatggagagtaaaatgtaaactgaagcacatattgtatctcttgtaaagtgaaaaagtattttcaagaacatcagacattgttttactgtgcagcatatttttcttagtaatttataaggtcatgatcttctgttattaaaacaaattcactggcatatttatgggaacgttttattgaatgccctttaagactattaataaaaacaagttttggatacc

SEQ ID NO: 9620 - DNA, 3363 bp, Homo sapiens
gcccccgcccggcccgcccggctctcctagtcccttgcaacctggcgctgccatccgggccactgtcccaggtcccggcccggagctatggagcggcgctggcccctggggctagggctggtgctgctgctctgcgccccgctgcccccgggggcgcgcgccaaggaagttactctgatggacacaagcaaggcacagggagagctgggctggctgctggatcccccaaaagatgggtggagtgaacagcaacagatactgaatgggacacccctgtacatgtaccaggactgcccaatgcaaggacgcagagacactgaccactggcttcgctccaattggatctaccgcggggaggaggcttcccgcgtccacgtggagctgcagttcaccgtgcgggactgcaagagtttccctgggggagccgggcctctgggctgcaaggagaccttcaaccttctgtacatggagagtgaccaggatgtgggcattcagctccgacggcccttgttccagaaggtaaccacggtggctgcagaccagagcttcaccattcgagaccttgtgtctggctccgtgaagctgaatgtggagcgctgctctctgggccgcctgacccgccgtggcctctacctcgctttccacaacccgggtgcctgtgtggccctggtgtctgtccgggtcttctaccagcgctgtcctgagaccctgaatggcttggcccaattcccagacactctgcctggccccgctgggttggtggaagtggcggggacctgcttgccccacgcgcgggccagccccaggccctcaggtgcaccccgcatgcactgcagccctgatggcgagtggctggtgcctgtaggacggtgccactgtgagcctggctatgaggaaggtggcagtggcgaagcatgtgttgcctgccctagcggctcctaccggatggacatggacacaccccattgtctcacgtgcccccagcagagcactgctgagtctgagggggccaccatctgtacctgtgagagcggccattacagagctcccggggagggcccccaggtggcatgcacaggtcccccctcggccccccgaaacctgagcttctctgcctcagggactcagctctccctgcgttgggaacccccagcagatacggggggacgccaggatgtcagatacagtgtgaggtgttcccagtgtcagggcacagcacaggacggggggccctgccagccctgtggggtgggcgtgcacttctcgccgggggcccgggggctcaccacacctgcagtgcatgtcaatggccttgaaccttatgccaactacacctttaatgtggaagcccaaaatggagtgtcagggctgggcagctctggccatgccagcacctcagtcagcatcagcatggggcatgcagagtcactgtcaggcctgtctctgagactggtgaagaaagaaccgaggcaactagagctgacctgggcggggtcccggccccgaagccctggggcgaacctgacctatgagctgcacgtgctgaaccaggatgaagaacggtaccagatggttctagaacccagggtcttgctgacagagctgcagcctgacaccacatacatcgtcagagtccgaatgctgaccccactgggtcctggccctttctcccctgatcatgagtttcggaccagcccaccagtgtccaggggcctgactggaggagagattgtagccgtcatctttgggctgctgcttggtgcagccttgctgcttgggattctcgttttccggtccaggagagcccagcggcagaggcagcagaggcagcgtgaccgcgccaccgatgtggatcgagaggacaagctgtggctgaagccttatgtggacctccaggcatacgaggaccctgcacagggagccctggactttacccgggagcttgatccagcgtggctgatggtggacactgtcataggagaaggagagtttggggaagtgtatcgagggaccctgaggctccccagccaggactgcaagactgtggccattaagaccttaaaagacacatccccaggtggccagtggtggaacttccttcgagaggcaactatcatgggccagtttagccacccgcatattctgcatctggaaggcgtcgtcacaaagcgaaagccgatcatgatcatcacagaatttatggagaatggagccctggatgccttcctgagggagcgggaggaccagctggtccctgggcagctagtggccatgctgcagggcatagcatctggcatgaactacctcagtaatcacaattatgtccaccgggacctggctgccagaaacatcttggtgaatcaaaacctgtgctgcaaggtgtctgactttggcctgactcgcctcctggatgactttgatggcacatacgaaacccagggaggaaagatccctatccgttggacagcccctgaagccattgcccatcggatcttcaccacagccagcgatgtgtggagctttgggattgtgatgtgggaggtgctgagctttggggacaagccttatggggagatgagcaatcaggaggttatgaagagcattgaggatgggtaccggttgccccctcctgtggactgccctgcccctctgtatgagctcatgaagaactgctgggcatatgaccgtgcccgccggccacacttccagaagcttcaggcacatctggagcaactgcttgccaacccccactccctgcggaccattgccaactttgaccccaggatgactcttcgcctgcccagcctgagtggctcagatgggatcccatatcgaaccgtctctgagtggctcgagtccatacgcatgaaacgctacatcctgcacttccactcggctgggctggacaccatggagtgtgtgctggagctgaccgctgaggacctgacgcagatgggaatcacactgcccgggcaccagaagcgcattctttgcagtattcagggattcaaggactgatccctcctctcaccccatgcccaatcagggtgcaaggagcaaggacggggccaaggtcgctcatggtcactccctgcgccccttcccacaacctgccagactaggctatcggtgctgcttctgcccactttcaggagaaccctgctctgcaccccagaaaacctctttgttttaaaagggaggtgggggtagaagtaaaaggatgatcatgggagggagctgaggggttaatatatatacatacatacacatatatatatttttgtaaataaacaggaactgattttctgcctccatcccacccatgagggctgcaggcactacaaaagagctgactactgagaa

SEQ ID NO: 9621 - DNA, 2050 bp, Homo sapiens
attgctcagcggtgctaggctggcgcggcttgagccgccgccggactgacagctcggtctgcggaccatggagacctgcgccggtccacacccgctgcgcctcttcctctgccggatgcagctctgtctcgcgctgcttttgggaccctggcggcctgggaccgccgaggaagttatcctcctggattccaaagcctcccaggccgagctgggctggactgcactgccaagtaatgggtgggaggagatcagcggcgtggatgaacacgaccgtcccatccgcacgtaccaagtgtgcaatgtgctggagcccaaccaggacaactggctgcagactggctggataagccgtggccgcgggcagcgcatcttcgtggaactgcagttcacactccgtgactgcagcagcatccctggcgccgcgggtacctgcaaggagaccttcaacgtctactacctggaaactgaggccgacctgggccgtgggcgtccccgcctaggcggcagccggccccgcaaaatcgacacgatcgcggcggacgagagcttcacgcagggcgacctgggtgagcgcaagatgaagctgaacacagaggtgcgcgagatcggaccgctcagccggcggggtttccacctggcctttcaggacgtgggcgcatgcgtggcgcttgtctcggtgcgcgtctactacaagcagtgccgcgccaccgtgcggggcctggccacgttcccagccaccgcagccgagagcgccttctccacactggtggaagtggccggaacgtgcgtggcgcactcggaaggggagcctggcagccccccacgcatgcactgcggcgccgacggcgagtggctggtgcctgtgggccgctgcagctgcagcgcgggattccaggagcgtggtgacttctgcgaaggtatccagttggctgggggccgtggggtgggagtgtagagcgtaggtggcaattgagagagagtgtgccctagaggaaagaggcgggtgtggggtcggggggcggtggagaagccttggactctggagcccaaggagagccctgaagtcttgtggagtttccagtgagtccagtcagggccaatgagtgaacttactagatgaaattgactggctaaggaggcattagggatctatatcttaggcaccttgcacaggccttctcgtttatttattttcatggcaataaaggaagtcattgtttttttttttttttaaaataaggagtctctcttgctctgttgcccaggctggagtgcactggcttgatcttggctaactgcaacttccacctcctgggttcaagcaattctcctgcctcagcctcctgagtagctgggattataggcgtgcaccaccatgcccagctaatttttgtatttttagtagagacggggtttcaccatgttggccaggctggtctcaaactcctgacctcaagtgatccacctacctaggccttccagagtgctgggattataggcgtgagccaccgtgcctggcctaaaggaagtcattcttatctctatttcacagatgaagaaacagagcctcagagagattagtacctcacttgcaaagttaggaaatggggagctaggatttgaattcaggcttgcccaactcacattctatgacatcatgaggtctcctcagtgcataaggaagaactctacagcagcccaatcttcaggctagtgggattggttgcattacagagaggaatctcccagtcacggaccaaatacttgcaagttagaggctggcaggggggatttttatgctggagagagggattgggaagttgcactagatgattacgaagatcacatcccactctctgaactacaatcactgtgctccctgggggagatccttcatgttgagggttttgctgggttctcaggctagtgggggcattaggaacagacctctcattctctctcttgcctgtggctttggatacagagggtgatgatggggttattaatgtgtgtacttaatatagaaagatcaaggtatgctttttctaaa

SEQ ID NO: 9622 - DNA, 2258 bp, Homo sapiens
tcctaagaagcactttctgccagcattgttcaacaaaggcagcctcagaagcgggtgaatgcctcatgataaagtatgtgacaaagactgtggctactgctggggaagctgccggaggaccaggccagtgggagctgagctagattatctctgaagcgccctgggaggaggatgagatccgcagggaccgagtggaaccccagagcgtgtccctgtcgtggcgggagcccatccctgccggagcccctggggccaatgacacggagtacgagatccgatactacgagaagggtcagagtgagcagacttactccatggtgaagacaggggcgcccacagtcaccgtcaccaacctgaagccggctacccgctacgtctttcagatccgggccgcttccccggggccatcctgggaggcccagagttttaaccccagcattgaagtacagaccctgggggaggctgcctcagggtccagggaccagagccccgccattgtcgtcaccgtagtgaccatctcggccctcctcgtcctgggctccgtgatgagtgtgctggccatttggaggaggccctgcagctatggcaaaggaggaggggatgcccatgatgaagaggagctgtatttccacttcaaagtcccaacacgtcgcacattcctggacccccagagctgtggggacctgctgcaggctgtgcatctgttcgccaaggaactggatgcgaaaagcgtcacgctggagaggagccttggaggagggcggtttggggagctgtgctgtggctgcttgcagctccccggtcgccaggagctgctcgtagccgtgcatatgctgagggacagcgcctccgactcacagaggctcggcttcctggccgaggccctcacgctgggccagtttgaccatagccacatcgtgcggctggagggcgttgttacccgaggaagcaccttgatgattgtcaccgagtacatgagccatggggccctggacggcttcctcaggcggcacgaggggcagctggtggctgggcaactgatggggttgctgcctgggctggcatcagccatgaagtatctgtcagagatgggctacgttcaccggggcctggcagctcgccatgtgctggtcagcagcgaccttgtctgcaagatctctggcttcgggcggggcccccgggaccgatcagaggctgtctacaccactatgagtggccggagcccagcgctatgggccgctcccgagacacttcagtttggccacttcagctctgccagtgacgtgtggagcttcggcatcatcatgtgggaggtgatggcctttggggagcggccttactgggacatgtctggccaagacgtgatcaaggctgtggaggatggcttccggctgccaccccccaggaactgtcctaaccttctgcaccgactaatgctcgactgctggcagaaggacccaggtgagcggcccaggttctcccagatccacagcatcctgagcaagatggtgcaggacccagagccccccaagtgtgccctgactacctgtcccaggcctcccaccccactagcggaccgtgccttctccaccttcccctcctttggctctgtgggcgcgtggctggaggccctggacctgtgccgctacaaggacagcttcgcggctgctggctatgggagcctggaggccgtggccgagatgactgcccaggacctggtgagcctaggcatctctttggctgaacatcgagaggccctcctcagcgggatcagcgccctgcaggcacgagtgctccagctgcagggccagggggtgcaggataataaaaacttgtctgtgatatggtgcctctttgagtggcagttgcttgatcattgtatagctggtgtggaagggcttctgcccccttcctcgaggacaggggtgtccagaatctgcgtctgagatctctctgcatagagggatttactgtcccacagctctggaggctggaagccaagatcaagatgtgcgcaaggttgtttcctgctgagagctgtgaggggagcttctgctctgggcctctctccccggcttgcctgtggccatcttcccactctctcttcgcatcatcttccctctatgccattgagtgtaagatgtcctaccaagaaagaaacatcacagccaactatgttgtgccatccaactgaaagatgcatcccagtttcagagatgttaacatgtacgtcttcaataaatgagatgccgcgcatc

SEQ ID NO: 9623 - DNA, 5425 bp, Homo sapiens
atggagacctgcgccggtccacacccgctgcgcctcttcctctgccggatgcagctctgtctcgcgctgcttttgggaccctggcggcctgggaccgccgaggaagttatcctcctggattccaaagcctcccaggccgagctgggctggactgcactgccaagtaatgggtgggaggagatcagcggcgtggatgaacacgaccgtcccatccgcacgtaccaagtgtgcaatgtgctggagcccaaccaggacaactggctgcagactggctggataagccgtggccgcgggcagcgcatcttcgtggaactgcagttcacactccgtgactgcagcagcatccctggcgccgcgggtacctgcaaggagaccttcaacgtctactacctggaaactgaggccgacctgggccgtgggcgtccccgcctaggcggcagccggccccgcaaaatcgacacgatcgcggcggacgagagcttcacgcagggcgacctgggtgagcgcaagatgaagctgaacacagaggtgcgcgagatcggaccgctcagccggcggggtttccacctggcctttcaggacgtgggcgcatgcgtggcgcttgtctcggtgcgcgtctactacaagcagtgccgcgccaccgtgcggggcctggccacgttcccagccaccgcagccgagagcgccttctccacactggtggaagtggccggaacgtgcgtggcgcactcggaaggggagcctggcagccccccacgcatgcactgcggcgccgacggcgagtggctggtgcctgtgggccgctgcagctgcagcgcgggattccaggagcgtggtgacttctgcgaagcctgtcccccagggttttacaaggtgtccccgcggcggcccctctgctcaccgtgcccagagcacagccgggccctggaaaacgcctccaccttctgcgtgtgccaggacagctatgcgcgctcacccaccgacccgccctcggcttcctgcacccggccgccgtcggcgccgcgggacctgcagtacagcctgagccgctcgccgctggtgctgcgactgcgctggctgccgccggccgactcgggaggccgctcggacgtcacctactcgctgctgtgcctgcgctgcggccgcgagggcccggcgggcgcctgcgagccgtgcgggccgcgcgtggccttcctaccgcgccaggcagggctgcgggagcgagccgccacgctgctgcacctgcggcccggcgcgcgctacaccgtgcgcgtggccgcgctcaacggcgtctcgggcccggcggccgccgcgggaaccacctacgcgcaggtcaccgtctccaccgggcccggggcgccctgggaggaggatgagatccgcagggaccgagtggaaccccagagcgtgtccctgtcgtggcgggagcccatccctgccggagcccctggggccaatgacacggagtacgagatccgatactacgagaagggtcagagtgagcagacttactccatggtgaagacaggggcgcccacagtcaccgtcaccaacctgaagccggctacccgctacgtctttcagatccgggccgcttccccggggccatcctgggaggcccagagttttaaccccagcattgaagtacagaccctgggggaggctgcctcagggtccagggaccagagccccgccattgtcgtcaccgtagtgaccatctcggccctcctcgtcctgggctccgtgatgagtgtgctggccatttggaggaggccctgcagctatggcaaaggaggaggggatgcccatgatgaagaggagctgtatttccacttcaaagtcccaacacgtcgcacattcctggacccccagagctgtggggacctgctgcaggctgtgcatctgttcgccaaggaactggatgcgaaaagcgtcacgctggagaggagccttggaggagggcggtttggggagctgtgctgtggctgcttgcagctccccggtcgccaggagctgctcgtagccgtgcatatgctgagggacagcgcctccgactcacagaggctcggcttcctggccgaggccctcacgctgggccagtttgaccatagccacatcgtgcggctggagggcgttgttacccgaggaagcaccttgatgattgtcaccgagtacatgagccatggggccctggacggcttcctcaggcggcacgaggggcagctggtggctgggcaactgatggggttgctgcctgggctggcatcagccatgaagtatctgtcagagatgggctacgttcaccggggcctggcagctcgccatgtgctggtcagcagcgaccttgtctgcaagatctctggcttcgggcggggcccccgggaccgatcagaggctgtctacaccactatgagtggccggagcccagcgctatgggccgctcccgagacacttcagtttggccacttcagctctgccagtgacgtgtggagcttcggcatcatcatgtgggaggtgatggcctttggggagcggccttactgggacatgtctggccaagacgtgatcaaggctgtggaggatggcttccggctgccaccccccaggaactgtcctaaccttctgcaccgactaatgctcgactgctggcagaaggacccaggtgagcggcccaggttctcccagatccacagcatcctgagcaagatggtgcaggacccagagccccccaagtgtgccctgactacctgtcccaggcctcccaccccactagcggaccgtgccttctccaccttcccctcctttggctctgtgggcgcgtggctggaggccctggacctgtgccgctacaaggacagcttcgcggctgctggctatgggagcctggaggccgtggccgagatgactgcccaggacctggtgagcctaggcatctctttggctgaacatcgagaggccctcctcagcgggatcagcgccctgcaggcacgagtgctccagctgcagggccagggggtgcaggtgtgagtggaccccattcttccaaggcaggactccggtgggggtccagtcccccagccctgcccaaggaccgtggcaagctgcgctccagcagtgtgggagggagcgctctcttcctctgcttgggcccagatctggtggggccacagcttccccgctttcactgcctgcccctcccattttcacgagtctgaacgccttggctaactcagtgcccctgaaaagaggttcaaatccctagggaggacccctgagataacagcaggaggaaattcggggtctcagagaaaagctggggcagggatgggagggaagacagtgggttgagattgccctggctcatgccctactgccatttgtacccactgggggctggggcctaccccgtggggtgttcccttttcccacagacccattgaccagtcagacagcgtgggtcctgggggggtcttcttctacctggcagtgactgcagctgcctggtggctcaggcgtcgggggctgggccagaggtgcatccacctcagctccctgtgccttggcaggggctgactggacactggccaaggctcaggcaggcaaagatggtgctgagctcaggggctgatacccaagagccctagactcaggatctggtttctgtgtccccctgccttgggctgacagttcagggtgaggccaaaagtcctggccaggccgggccatgagaggccctggtgctccctggggccccatgaggccctcgtgtgcattccttttatgaacttagtggccaggacatctgggaaaagcataaagggccatgttatctccccagggacccaagagcttttctctccagccatggggagggtgaagaggagactcagagatgggtcctctctctcaaacaggctggtctaacccccagtgtacagatgggggaaactgaggccaagtgaggagtcaggagcagagctgaggtcagaacccaatccaggggtaaggctggctctggggagagagtccttggtcctgccctatggcaccaccacttccctgtacagcccttggggactctagaggcgactcccctccagccagctccgtgccttgggcactacccagccttccatggagcccctccctgctctgactttgaagagccctggcagaagtggttgtgctgagcccaccgtggagttccttatccacaagggcccccgggaatggtggggcccagtatgccagagctttcgtagggtggcaggaaggcagctggatctcagcagggccacagggactgagtttgtttaggccgcccgtgacacttgtctgctctgcttggctgtgtgttggtggggtgggatggggcgggaaagaggagacaagaggtaaagatgaaaaagacacacagcctgcccttggggggctcagactagaccaggagaagagctcaggtaccaagaagtaattccagggcaccatccacagtgcccagggccccccaggagccctctgggtcagtgggtaggtgggctggagggggagatagccactctcttaatgtgtgaagttgagatgtaagttgaacagggccttgcaggtgggaaagggaaggttctttccttggggtgggtggagttttcggcaggcaagatggcaggcctcggacaaaaggagtccatgcagagaggctagcatgagaaagagcccagaggcgggaaggtgcagtgcctctttgcagagcacccagaggtgggggacagtgactcacagaggtgcctttggccttaccctgccagcagcagctcccctgctcttggaatctccccccagccccctgcctccctgtctcctgagcacctgccccagctcagtgactctgggggtactggggagaccaagatgttgctaccaccttagtcagggttgggggagcccccggccaggtgccctccaggatccgccttccccacccctcctgggaagcctggaccagcatcccttcttgggtggatggagcctcgtcctcatctccagctacatcagtcattctctgcagggcaaaatctcctccccctaccccagctgtttctgcagaagggcccctggctgtgttggcaggacttcggtgtccagggtagatctcccctccactgaggagtgaggtcccagaatcctgttgggtcccaggcctcagccctgcacagatgtgatgtggggcgatggctctctgggaaccctctacagatctatttttatatggaacttgttcactggacagaggtggcctgcaagcccccattaccctggtctgagctcaccctgggagggagggggccagtcggagggggttccttctggagatgtttttatatttcttgggttctctatgcaggataataaaaacttgtctgtgata

SEQ ID NO: 9624 - DNA, 3461 bp, Homo sapiens
atggagacctgcgccggtccacacccgctgcgcctcttcctctgccggatgcagctctgtctcgcgctgcttttgggaccctggcggcctgggaccgccgaggaagttatcctcctggattccaaagcctcccaggccgagctgggctggactgcactgccaagtaatgggtgggaggagatcagcggcgtggatgaacacgaccgtcccatccgcacgtaccaagtgtgcaatgtgctggagcccaaccaggacaactggctgcagactggctggataagccgtggccgcgggcagcgcatcttcgtggaactgcagttcacactccgtgactgcagcagcatccctggcgccgcgggtacctgcaaggagaccttcaacgtctactacctggaaactgaggccgacctgggccgtgggcgtccccgcctaggcggcagccggccccgcaaaatcgacacgatcgcggcggacgagagcttcacgcagggcgacctgggtgagcgcaagatgaagctgaacacagaggtgcgcgagatcggaccgctcagccggcggggtttccacctggcctttcaggacgtgggcgcatgcgtggcgcttgtctcggtgcgcgtctactacaagcagtgccgcgccaccgtgcggggcctggccacgttcccagccaccgcagccgagagcgccttctccacactggtggaagtggccggaacgtgcgtggcgcactcggaaggggagcctggcagccccccacgcatgcactgcggcgccgacggcgagtggctggtgcctgtgggccgctgcagctgcagcgcgggattccaggagcgtggtgacttctgcgaagcctgtcccccagggttttacaaggtgtccccgcggcggcccctctgctcaccgtgcccagagcacagccgggccctggaaaacgcctccaccttctgcgtgtgccaggacagctatgcgcgctcacccaccgacccgccctcggcttcctgcacccggccgccgtcggcgccgcgggacctgcagtacagcctgagccgctcgccgctggtgctgcgactgcgctggctgccgccggccgactcgggaggccgctcggacgtcacctactcgctgctgtgcctgcgctgcggccgcgagggcccggcgggcgcctgcgagccgtgcgggccgcgcgtggccttcctaccgcgccaggcagggctgcgggagcgagccgccacgctgctgcacctgcggcccggcgcgcgctacaccgtgcgcgtggccgcgctcaacggcgtctcgggcccggcggccgccgcgggaaccacctacgcgcaggtcaccgtctccaccgggcccggggcgccctgggaggaggatgagatccgcagggaccgagtggaaccccagagcgtgtccctgtcgtggcgggagcccatccctgccggagcccctggggccaatgacacggagtacgagatccgatactacgagaagggtcagagtgagcagacttactccatggtgaagacaggggcgcccacagtcaccgtcaccaacctgaagccggctacccgctacgtctttcagatccgggccgcttccccggggccatcctgggaggcccagagttttaaccccagcattgaagtacagaccctgggggaggctgcctcagggtccagggaccagagccccgccattgtcgtcaccgtagtgaccatctcggccctcctcgtcctgggctccgtgatgagtgtgctggccatttggaggaggccctgcagctatggcaaaggaggaggggatgcccatgatgaagaggagctgtatttccacttcaaagtcccaacacgtcgcacattcctggacccccagagctgtggggacctgctgcaggctgtgcatctgttcgccaaggaactggatgcgaaaagcgtcacgctggagaggagccttggaggagggcggtttggggagctgtgctgtggctgcttgcagctccccggtcgccaggagctgctcgtagccgtgcatatgctgagggacagcgcctccgactcacagaggctcggcttcctggccgaggccctcacgctgggccagtttgaccatagccacatcgtgcggctggagggcgttgttacccgaggaagcaccttgatgattgtcaccgagtacatgagccatggggccctggacggcttcctcaggcggcacgaggggcagctggtggctgggcaactgatggggttgctgcctgggctggcatcagccatgaagtatctgtcagagatgggctacgttcaccggggcctggcagctcgccatgtgctggtcagcagcgaccttgtctgcaagatctctggcttcgggcggggcccccgggaccgatcagaggctgtctacaccactatgagtggccggagcccagcgctatgggccgctcccgagacacttcagtttggccacttcagctctgccagtgacgtgtggagcttcggcatcatcatgtgggaggtgatggcctttggggagcggccttactgggacatgtctggccaagacgtgatcaaggctgtggaggatggcttccggctgccaccccccaggaactgtcctaaccttctgcaccgactaatgctcgactgctggcagaaggacccaggtgagcggcccaggttctcccagatccacagcatcctgagcaagatggtgcaggacccagagccccccaagtgtgccctgactacctgtcccaggcctcccaccccactagcggaccgtgccttctccaccttcccctcctttggctctgtgggcgcgtggctggaggccctggacctgtgccgctacaaggacagcttcgcggctgctggctatgggagcctggaggccgtggccgagatgactgcccaggacctggtgagcctaggcatctctttggctgaacatcgagaggccctcctcagcgggatcagcgccctgcaggcacgagtgctccagctgcagggccagggggtgcaggtgataataaaaacttgtctgtgatatggtgcctctttgagtggcagttgcttgatcattgtatagctggtgtggaagggcttctgcccccttcctcgaggacaggggtgtccagaatctgcgtctgagatctctctgcatagagggatttactgtcccacagctctggaggctggaagccaagatcaagatgtgcgcaaggttgtttcctgctgagagctgtgaggggagcttctgctctgggcctctctccccggcttgcctgtggccatcttcccactctctcttcgcatcatcttccctctatgccattgagtgtaagatgtcctaccaagaaagaaacatcacagccaactatgttgtgccatccaactgaaagatgcatcccagtttcagagatgttaacatgtacgtcttcaataaatgagatgccgcgcatc

SEQ ID NO: 9625 - DNA, 2332 bp, Homo sapiens
gcgcaggtcaccgtctccaccgggcccggggcgccctgggaggaggatgagatccgcagggaccgagtggaaccccagagcgtgtccctgtcgtggcgggagcccatccctgccggagcccctggggccaatgacacggagtacgagatccgatactacgagaagggtcagagtgagcagacttactccatggtgaagacaggggcgcccacagtcaccgtcaccaacctgaagccggctacccgctacgtctttcagatccgggccgcttccccggggccatcctgggaggcccagagttttaaccccagcattgaagtacagaccctgggggaggctgcctcagggtccagggaccagagccccgccattgtcgtcaccgtagtgaccatctcggccctcctcgtcctgggctccgtgatgagtgtgctggccatttggaggaggccctgcagctatggcaaaggaggaggggatgcccatgatgaagaggagctgtatttccacttcaaagtcccaacacgtcgcacattcctggacccccagagctgtggggacctgctgcaggctgtgcatctgttcgccaaggaactggatgcgaaaagcgtcacgctggagaggagccttggaggaggcttggaaacctccccccactgaggaaggcagagaggaatccccatttcacagaggagacaggccaagaaaaggaaagagatggaattcgaggtcacactgctggtactcagtttaccaggatttaagctggaaacagtccatgatctggagtcacttttttttttgagaccgagtcttgctctgtcacccagtctgaagtgcagtggcacaatctcagctcactgaaacctctgcctcctgggttcaagtgattttcctgcctcagcttctcaagtagctgggattacagggcggtttggggagctgtgctgtggctgcttgcagctccccggtcgccaggagctgctcgtagccgtgcatatgctgagggacagcgcctccgactcacagaggctcggcttcctggccgaggccctcacgctgggccagtttgaccatagccacatcgtgcggctggagggcgttgttacccgaggaagcaccttgatgattgtcaccgagtacatgagccatggggccctggacggcttcctcaggcggcacgaggggcagctggtggctgggcaactgatggggttgctgcctgggctggcatcagccatgaagtatctgtcagagatgggctacgttcaccggggcctggcagctcgccatgtgctggtcagcagcgaccttgtctgcaagatctctggcttcgggcggggcccccgggaccgatcagaggctgtctacaccactatgagtggccggagcccagcgctatgggccgctcccgagacacttcagtttggccacttcagctctgccagtgacgtgtggagcttcggcatcatcatgtgggaggtgatggcctttggggagcggccttactgggacatgtctggccaagacgtgatcaaggctgtggaggatggcttccggctgccaccccccaggaactgtcctaaccttctgcaccgactaatgctcgactgctggcagaaggacccaggcctcccaccccactagcggaccgtgccttctccaccttcccctcctttggctctgtgggcgcgtggctggaggccctggacctgtgccgctacaaggacagcttcgcggctgctggctatgggagcctggaggccgtggccgagatgactgcccaggacctggtgagcctaggcatctctttggctgaacatcgagaggccctcctcagcgggatcagcgccctgcaggcacgagtgctccagctgcagggccagggggtgcaggtgataataaaaacttgtctgtgatatggtgcctctttgagtggcagttgcttgatcattgtatagctggtgtggaagggcttctgcccccttcctcgaggacaggggtgtccagaatctgcgtctgagatctctctgcatagagggatttactgtcccacagctctggaggctggaagccaagatcaagatgtgcgcaaggttgtttcctgctgagagctgtgaggggagcttctgctctgggcctctctccccggcttgcctgtggccatcttcccactctctcttcgcatcatcttccctctatgccattgagtgtaagatgtcctaccaagaaagaaacatcacagccaactatgttgtgccatccaactgaaagatgcatcccagtttcagagatgttaacatgtacgtcttcaataaatgagatgccgcgcatc

SEQ ID NO: 9626 - DNA, 3964 bp, Homo sapiens
ggttctcacccaacttccattaaggactcggggcaggaggggcagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccctccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatatgggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaaccga

SEQ ID NO: 9627 - DNA, 5809 bp, Homo sapiens
cccgctctgcttcagcgcacgctgaagacggcactaggacccagggaagtccccgagcggggttcgcggaaaggcagccagactcctccttatctccagtgtcaaacttgacatcagcctgcgagcggagcatggtaacttctccagcaatcagagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaagtcaatctactggattcaaaaacaattcaaggggagctgggctggatctcttatccatcacatgggtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaagcttgtcgaccaggtttctacaaggcattggatggtaatatgaagtgtgctaagtgcccgcctcacagttctactcaggaagatggttcaatgaactgcaggtgtgagaataattacttccgggcagacaaagaccctccatccatggcttgtacccgacctccatcttcaccaagaaatgttatctctaatataaacgagacctcagttatcctggactggagttggcccctggacacaggaggccggaaagatgttaccttcaacatcatatgtaaaaaatgtgggtggaatataaaacagtgtgagccatgcagcccaaatgtccgcttcctccctcgacagtttggactcaccaacaccacggtgacagtgacagaccttctggcacatactaactacacctttgagattgatgccgttaatggggtgtcagagctgagctccccaccaagacagtttgctgcggtcagcatcacaactaatcaggctgctccatcacctgtcctgacgattaagaaagatcggacctccagaaatagcatctctttgtcctggcaagaacctgaacatcctaatgggatcatattggactacgaggtcaaatactatgaaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactctttctccatctctggtgaaagtagccaagtggtcatgatcgccatttcagcggcagtagcaattattctcctcactgttgtcatctatgttttgattgggaggttctgtggctataagtcaaaacatggggcagatgaaaaaagacttcattttggcaatgggcatttaaaacttccaggtctcaggacttatgttgacccacatacatatgaagaccctacccaagctgttcatgagtttgccaaggaattggatgccaccaacatatccattgataaagttgttggagcaggtgaatttggagaggtgtgcagtggtcgcttaaaacttccttcaaaaaaagagatttcagtggccattaagaccctgaaagttggctacacagaaaagcagaggagagacttcctgggagaagcaagcattatgggacagtttgaccaccccaatatcattcgactggaaggagttgttaccaaaagtaagccagttatgattgtcacagaatacatggagaatggttccttggatagtttcctacgtaaacacgatgcccagtttactgtcattcagctagtggggatgcttcgagggatagcatctggcatgaagtacctgtcagacatgggctatgttcaccgagacctcgctgctcggaacatcttgatcaacagtaacttggtgtgtaaggtttctgatttcggactttcgcgtgtcctggaggatgacccagaagctgcttatacaacaagaggagggaagatcccaatcaggtggacatcaccagaagctatagcctaccgcaagttcacgtcagccagcgatgtatggagttatgggattgttctctgggaggtgatgtcttatggagagagaccatactgggagatgtccaatcaggatgtaattaaagctgtagatgagggctatcgactgccaccccccatggactgcccagctgccttgtatcagctgatgctggactgctggcagaaagacaggaacaacagacccaagtttgagcagattgttagtattctggacaagcttatccggaatcccggcagcctgaagatcatcaccagtgcagccgcaaggccatcaaaccttcttctggaccaaagcaatgtggatatcactaccttccgcacaacaggtgactggcttaatggtgtctggacagcacactgcaaggaaatcttcacgggtgtggagtacagttcttgtgacacaatagccaagatttccacagatgacatgaaaaaggttggtgtcaccgtggttgggccacagaagaagatcatcagtagcattaaagctctagaaacgcaatcaaagaatggcccagttcccgtgtaaagcacgggacggaagtgcttctggacggaagtggtggctgtggaaggcgtagcatcatcctgcagacagacaataattctggagatactggtggaagttccaagtccaataagacactcaaatatgagtacaaatgccttaaaatggaattgaaaaactctttattttcccctatcatttattggatgggtgggtggggtatttttttgtaattgcttttttaaatattagttaatggattaaatttaattcttcagcgtaaaatggtgaagaactagcatatagccattgatcataaactgactatcataaaatcaaaacaagtgaaataacaaaatggacatggtggctttgtttaggtagagccacaaaagaaaagacttgtaatatttttatatacagaggaaatctgtaacaggtattttgtttcttttaaagcaagcaacacagaggaatttatacctcaaactatctggccatatttactaccttatcactgcattattctcttttatctgtttaaagcatatagagatgaagtttgtagttgttttaagtactacacatttttaaattgttagcttccttaagtatatcatgtaaagaaatgtcttaatttttgaaaaaagtacatatttattttcttttgaattgtttttattgttttctatttatgccttgatgatttaatatggatttgttacagccaagtgccaaatgctctctcaaattgtcagcaatttaactagacacagataataatgggtttctttcagattttttgaaccatccacttacatatatttttaaaaaatgaaatccttttcctgttcatacactaaccaaatctctcaaatctgttatcccaatcattgttgcctctccgtttattataaactgtatgctcacaacttagtgtaatataccagcttgtatgcaatggattttcaaccagataacatacctttcctgctctggtgcttagagactatcaactccctcctttagtgaaggagccgtgttagagcttccgagaatagctccactggagagaagtggaatcctatatagaatgctgcactaattgacaacacagcctataggccaatgcatgagtaaaaaaaaaaacaattactggctcactggctttgaaaagtcacttactattgttgctgaaacttgctgagctgtttatagagaatgatgataacagaacttttcctctgtatcactggtgtttaggtgaattaattaaacattgtgatcattagtaccaggtattattatctttaagagtcttccacttcaatgcacatggtgcagttttggtgtgtaacttagaaggattgaacttctttgaatttactggacataacattttcagaatagttggtcatctagcaaccgcctcaaaatgtgtaagcaggagagaaatttctcatcacagggatttagacttactattacataaaggctaactatgagcttgctcattaattttgaaaagatgtacctggtggatatctagctagtaatatattctgaagcaacattttagctctattgatactctttctaatgctgatatgatcttgagtataagaaatgcatatgtcactagaatggataaaataatgctgcaaacttaatgttcttatgcaaaatggaacgctaatgaaacacagcttacaatcgcaaatcaaaactcacaagtgctcatctgttgtagatttagtgtaataagacttagattgtgctccttcggatatgattgtttctcaaatcttggcaatattccttagtcaaatcaggctactagaattctgtattggatatataagagcatgaaatttttaaaaatacacttgtgattataaaattaatcacaaatttcacttatacctgctatcagcagctagaaaacattttttttttaaatcaagtattttgtgtttggaatgttagaatgagatctgaatgtggtttcaatctaattttttcccagactactattttcttttttaggtactattctgagcatactcaacaaaacccatgcatttcataaactaatagaagttgaggattgttgaatctatttcacttattttggctgtggtttccatctgaaagtagaggttgtatacaccatatactgttcttcattttattaatatttttctccttgacctctcataaatttactttacacaattcttaccctgtacatatgtaaacataagtgtacgattcttaaccatggagtagaggtactagaatgcttacggccatctctttgtacaggaactgcattgactttcagtaaacataaagccacaactcctacatgatgttatgtaccatatgatctgttttgtatcttaaatttgatttacatatattatttatttctggtaactcactcagtttatgctgtgctaaatatcaatcaagccatgtataaatgtgatatgattggcaatatgtgtttactttaaacttgtcttttcaaaatattactcagtttatgttgtacaatgtagatggcctcttactaatgtaaaatgatttgtagtggaaacatttatatttttataataaacataatgaaaatattttttacagattggaa

SEQ ID NO: 9628 - DNA, 2546 bp, Homo sapiens
cttctccagcaatcagagcgctccccctcacatcagtggcatgcttcatggagatatgctcctctcactgccctctgcaccagcaacatggattgtcagctctccatcctcctccttctcagctgctctgttctcgacagcttcggggaactgattccgcagccttccaatgaagtcaatctactggattcaaaaacaattcaaggggagctgggctggatctcttatccatcacatgggtgggaagagatcagtggtgtggatgaacattacacacccatcaggacttaccaggtgtgcaatgtcatggaccacagtcaaaacaattggctgagaacaaactgggtccccaggaactcagctcagaagatttatgtggagctcaagttcactctacgagactgcaatagcattccattggttttaggaacttgcaaggagacattcaacctgtactacatggagtctgatgatgatcatggggtgaaatttcgagagcatcagtttacaaagattgacaccattgcagctgatgaaagtttcactcaaatggatcttggggaccgtattctgaagctcaacactgagattagagaagtaggtcctgtcaacaagaagggattttatttggcatttcaagatgttggtgcttgtgttgccttggtgtctgtgagagtatacttcaaaaagtgcccatttacagtgaagaatctggctatgtttccagacacggtacccatggactcccagtccctggtggaggttagagggtcttgtgtcaacaattctaaggaggaagatcctccaaggatgtactgcagtacagaaggcgaatggcttgtacccattggcaagtgttcctgcaatgctggctatgaagaaagaggttttatgtgccaagcttgtcgaccaggtttctacaaggcattggatggtaatatgaagtgtgctaagtgcccgcctcacagttctactcaggaagatggttcaatgaactgcaggtgtgagaataattacttccgggcagacaaagaccctccatccatggcttgtacccgacctccatcttcaccaagaaatgttatctctaatataaacgagacctcagttatcctggactggagttggcccctggacacaggaggccggaaagatgttaccttcaacatcatatgtaaaaaatgtgggtggaatataaaacagtgtgagccatgcagcccaaatgtccgcttcctccctcgacagtttggactcaccaacaccacggtgacagtgacagaccttctggcacatactaactacacctttgagattgatgccgttaatggggtgtcagagctgagctccccaccaagacagtttgctgcggtcagcatcacaactaatcaggctgctccatcacctgtcctgacgattaagaaagatcggacctccagaaatagcatctctttgtcctggcaagaacctgaacatcctaatgggatcatattggactacgaggtcaaatactatgaaaagcaggaacaagaaacaagttataccattctgagggcaagaggcacaaatgttaccatcagtagcctcaagcctgacactatatacgtattccaaatccgagcccgaacagccgctggatatgggacgaacagccgcaagtttgagtttgaaactagtccagactgtatgtattatttcaatgcagtctagaggagggggcagggatcttgcaaaagatgtctgatcgtttattctcactgtttctaagttttaaacaaatgtgatacatttaaggtatattgcttgggacattgcaatttgcagagccctgtgtctgtatacagtatttgtgtttgtgtgggtgtacattttgtgtttctttttttcttgtatgcaaatcaaacatattctaatgcctgaaatgcttctgttttttttttttagccataaattgcttttgaggaacattatttaatatagtaacacacttccagtgtctgtcatttcagatattccaggttcattgcgtgattcaatgaaccacaaaaaagaaacttgctgatccatgagaatcttaattttgttttaatccttaacacattcaatagcatatcacagagagaataaggattttctaaaatgtgttttatcacttcattcacattcagaagtaatttgaatagcctgttcctttaaccccaaatttggctaaaattggcctaaaactggcaaacatttttccagtaacttttctttttttcaaatgaattttcttcatacttaaaaaagccctttgctaaaatataattttcaaaaaggtaaaattatgtctatggcactaatataaaatgagtagaagttaatgattttacttaactcatttttttctttctttctttttttttttttttttttgagacggagtcttgctctgtcacccaggctggagtacagcagagcgatctcggctcactgcaagctcctgcaagctccgcctcctggcttcacgccattctccccctcagcctcccgagtagctgggactacag

SEQ ID NO: 9629 - DNA, 8266 bp, Homo sapiens
tccctcccctcttcagcactcagcccgcagctatttccttctgccagtctctttgaactctggatctttgcttttgctcgctgctctcctgtttttcattctccacattttctcaagtcctctttctttatccttagccaccctgcttttttcctccttttttaaaaaatcggagatttcgtcttaaaatgatttgccttccttaccttcgtccatttcaacactgaaggctgcaaagaaccttcacctttcccctagtggtatttaaaaattctcaatccgtaaaaagtctttttgaaaggcaaaggaacaggacccaggaccctctcgacacccttgatccgagtccagatctgcactagcaaccagaactaatatttcatttaaccccaccaaagggggaggcgagaggagccagaagcaaacttcagctgtctcagccggatccgtggttcctacatttggaggagccgcgtgccagaaggcgtaggaccccaaggggggacaaggaggactcccgagtctcccttcgccgctctgcgaggccgaagcggtggactgagccgctcgggacagcggcaccggaggaggctcggagaagatgcggggctcggggccccggggtgcgggacgccggcggcccccaagcggcggcggcgacacccccatcaccccagcgtccctggccggctgctactctgcacctcgacgggctcccctctggacgtgccttctcctgtgcgccgcactccggaccctcctggccagccccagcaacgaagtgaatttattggattcacgcactgtcatgggggacctgggatggattgcttttccaaaaaatgggtgggaagagattggtgaagtggatgaaaattatgcccctatccacacataccaagtatgcaaagtgatggaacagaatcagaataactggcttttgaccagttggatctccaatgaaggtgcttccagaatcttcatagaactcaaatttaccctgcgggactgcaacagccttcctggaggactggggacctgtaaggaaacctttaatatgtattactttgagtcagatgatcagaatgggagaaacatcaaggaaaaccaatacatcaaaattgataccattgctgccgatgaaagctttacagaacttgatcttggtgaccgtgttatgaaactgaatacagaggtcagagatgtaggacctctaagcaaaaagggattttatcttgcttttcaagatgttggtgcttgcattgctctggtttctgtgcgtgtatactataaaaaatgcccttctgtggtacgacacttggctgtcttccctgacaccatcactggagctgattcttcccaattgctcgaagtgtcaggctcctgtgtcaaccattctgtgaccgatgaacctcccaaaatgcactgcagcgccgaaggggagtggctggtgcccatcgggaaatgcatgtgcaaggcaggatatgaagagaaaaatggcacctgtcaagtgtgcagacctgggttcttcaaagcctcacctcacatccagagctgcggcaaatgtccacctcacagttatacccatgaggaagcttcaacctcttgtgtctgtgaaaaggattatttcaggagagagtctgatccacccacaatggcatgcacaagacccccctctgctcctcggaatgccatctcaaatgttaatgaaactagtgtctttctggaatggattccgcctgctgacactggtggaaggaaagacgtgtcatattatattgcatgcaagaagtgcaactcccatgcaggtgtgtgtgaggagtgtggcggtcatgtcaggtaccttccccggcaaagcggcctgaaaaacacctctgtcatgatggtggatctactcgctcacacaaactatacctttgagattgaggcagtgaatggagtgtccgacttgagcccaggagcccggcagtatgtgtctgtaaatgtaaccacaaatcaagcagctccatctccagtcaccaatgtgaaaaaagggaaaattgcaaaaaacagcatctctttgtcttggcaagaaccagatcgtcccaatggaatcatcctagagtatgaaatcaagtattttgaaaaggaccaagagaccagctacacgattatcaaatctaaagagacaactattactgcagagggcttgaaaccagcttcagtttatgtcttccaaattcgagcacgtacagcagcaggctatggtgtcttcagtcgaagatttgagtttgaaaccaccccagtgtttgcagcatccagcgatcaaagccagattcctgtaattgctgtgtctgtgacagtgggagtcattttgttggcagtggttatcggcgtcctcctcagtggaagttgctgcgaatgtggctgtgggagggcttcttccctgtgcgctgttgcccatccaagcctaatatggcggtgtggctacagcaaagcaaaacaagatccagaagaggaaaagatgcattttcataatgggcacattaaactgccaggagtaagaacttacattgatccacatacctatgaggatcccaatcaagctgtccacgaatttgctaaggagatagaagcatcatgtatcaccattgagagagttattggagcaggtgaatttggtgaagtttgtagtggacgtttgaaactaccaggaaaaagagaattacctgtggctatcaaaacccttaaagtaggctatactgaaaagcaacgcagagatttcctaggtgaagcaagtatcatgggacagtttgatcatcctaacatcatccatttagaaggtgtggtgaccaaaagtaaaccagtgatgatcgtgacagagtatatggagaatggctctttagatacatttttgaagaaaaacgatgggcagttcactgtgattcagcttgttggcatgctgagaggtatctctgcaggaatgaagtacctttctgacatgggctatgtgcatagagatcttgctgccagaaacatcttaatcaacagtaaccttgtgtgcaaagtgtctgactttggactttcccgggtactggaagatgatcccgaggcagcctacaccacaaggggaggaaaaattccaatcagatggactgccccagaagcaatagctttccgaaagtttacttctgccagtgatgtctggagttatggaatagtaatgtgggaagttgtgtcttatggagagagaccctactgggagatgaccaatcaagatgtgattaaagcggtagaggaaggctatcgtctgccaagccccatggattgtcctgctgctctctatcagttaatgctggattgctggcagaaagagcgaaatagcaggcccaagtttgatgaaatagtcaacatgttggacaagctgatacgtaacccaagtagtctgaagacgctggttaatgcatcctgcagagtatctaatttattggcagaacatagcccactaggatctggggcctacagatcagtaggtgaatggctagaggcaatcaagatgggccggtatacagagattttcatggaaaatggatacagttcaatggacgctgtggctcaggtgaccttggaggatttgagacggcttggagtgactcttgtcggtcaccagaagaagatcatgaacagccttcaagaaatgaaggtgcagctggtaaacggaatggtgccattgtaacttcatgtaaatgtcgcttcttcaagtgaatgattctgcactttgtaaacagcactgagatttattttaacaaaaaaagggggaaaagggaaaacagtgatttctaaaccttagaaaacatttgcctcagccacagaatttgtaatcatggttttactgaagtatccagttcttagtccttagtcttcatttttcatgaagcaaacatatcttgcattaaaagggacatgaagttagacatcatcttaagttacaacaacagaatccttcccactacttctacaaaattttgtacatgaaatatataattatatagcacttttatagactgaattaaggcaacccctttcaaaacttccagggatctacttgaaaggaaatgttttatagccatttgtgagctaacaaaagctacagtttactgaagtttacttcaagtcttaattgtctacaaaagtgtattgaagagcaatatgattagattatttcttaatagatatcttcttttgtaattttaaaatgctgttacacagcgttaagttatagaaactagtgtgtaaacatgttgcttgatcaagaaaaagtacaatacagggtgtatatttattttttgtgttataaagtttacttttagttgctcttctagagattattaggtaataaatgtgtatatactgtataatttgcaatatacccaggaactgatttaagatggaattgtgtgtgtgtttgcttgcacatgtgtgtgttaccattctgcttgcatttctaatagtgtttcaattttagcaacatataggagcaagtgttccagaatgtaatatgaataggagaaatagggaagcagtaaaacaaaatttaacacaagcttgtgtctcttttcctctcatgtgtccaaaagctaatctctttattcactaaaaggaaatgtgtataagactaaatcccctttggctttttaaaaacattttgtgatatcagtgacaatgcagttcttctagccattaatcttgtacccctgtaagaaatttcacctttctgagtcctgaaaagtatcttgtcaagcaaagttgacaccgaagggcacattttcagcaggatgtagaaggatttaactgtgcaggcttctgttaatgttgttaaatccaggcacatagcacgaagcatcacccttaagtgttaatccgttgtaaccattcccattttgactcagttctagaaattttgactctaaggcagcaatggaattatgacaaatatatatatatacacatacacacacacaaatatatatatatgcttatttcccttcagaattttatttcaataattgataagttttatttttaatggatgtttattcatttgttaatttcagtttgtattcagttacatggctttgagtttattttattgaaccaatccaaggtattatgtaattaggcttattaaggaatataacatatcttctatgtatgctctatataccacacatgatgaagacttatatttgtgatacaaattatgcagtgtattagaaattgtccaaaactgagctcctgagataaccaacatttttgtattattacactttataaaaattatggaatgtcatgtgattagtcaaaatcagagcatttaaataaaatacagcctactcatgattatcaatgttaatagtacagtagatcagagaagcctggattaatgaaatttatcagaaatatagccacgttatattaatggtattcttttttccaagcacttgttttatttgaatattagcacatataagaataaacttttgggaaataactacttcctattctgcccaccctttacttaagcagtaaagtacctcttttctaaagaaccaggaaacatcaaaataaccacaacaaaaatctaaacagttttcaaataatacattcagttctcataataataagggctatataccatgggtccacacaaactgtgctgcaaacatataatctattagtttagtaaaatttccagagatgtgaatttaatattttcttgataaaatcataaaaaagcatcaccattattaaagatgcatttgttcatttcaataaacagaaattaatgaaacaaattacttttgtacaaaataaatgatgattatgtggcactttattgaattttatagaaatattccaatctaagtgataaagtaacaactgagaaacttcagaatgaaagccttattgattcaaaaggaaaattaccatatgctttagggctgatgaacttgccacaattgcttagacataacaaagatattttctacattgttttccaactttatatgctgaaagataattaggaggtccgggtggagtgtatctaaatgactagaactttaagttgcaatatagattttctctttttaacaaaggaagaatataaattaatttggatcaaatttatttgccttctttgcaatcttggtgatcattttggaaagtaaattgaaaggaaagttaaatagccacatagttttcttttgcatctcaatttggttgagaatttctaaggaaggttaatatgactttagaatgaataaagagactgtcaaacaacaagtactctccctaaaaaagaggaaagaatgccttcctaaaatatttgtttcctattgtatatgtcaccaattggaaaatgccaatctcatctgcaagtgtgagaaatggaacaaggagaggagccaactctagtaaaatgtagtgaggccataatccaaggcaaagtttaacaaatcttgattgtgtaatttcttattctgttgattcattttgtcacccaccagactaccaaaaataaagcacagacatgacaattttagtatatacaacagatttggcaaataatacataatcttattgtaattgccagtagcaatatcttaaggggcatgagtctttcacagtattggactttgaaaaattggtacagggagtaattttcaacagactgatacttgaagtcactcaattactactttgacctatcataatttgtttctaatcttgtcatttgctcatatatactattaatataaccagttgctcttttcataatgtactatttctatgtaaagatgtaaagattttgattttcctatgttttaaaattgtaatgtgcatgatcttttatttcttgtgtttcaattaccaagtcagtattctaaggttgtaagattactgtaaaaattatattccaatattttatctaaacttaagtgtggccagcattattggtttcagagttgcctaaacaacacagaatatccttaattcagtttgtaaaagagttttgaccagtgtaaaaaagtgaagacacagtttcatgtttcaagtttaaaatggaaagttaatatcatttgagcacttatgtgttttcatgtcttctacttaatctgtatgtgaaagtaaaatatttttaacaccattatttatgccatgtaaagtgggttctcagaagcacaagcacagatatttaccttctgaagacatttttggctataaaagtgcattggatggcaaacactatttgagtcaggtgttagaaatttattagatgtattatattacatagtagaataaggtccctttctcattttgtttttcctaaaaataagaaaaaaaagaagtgtgatagtaaactgtctttgctaatgtcctgccagatgtttaacttcaaattaagcaaaaagtaggtacaatatgatgatgatcctgatgatgatgatgatgatgatgatgaagaataaatggaatcaaaatgctagctttatttgacattaataagtaaaataagtcatcattttttcaactctgtagcacagctgtttacattgaataattttctctattgtgctgttaattatatagtaatgtatcaaaatagaaataggaactttcttttcatttcttattcatttatgaagaaatcttttcacacataaatgattgaatgttcttgttcagaatgaccacataatcattgcttagaagaagataccaattcttttaaaagaaaaaaagtctgtttataataatcagaatcaaatgttgtttgtttcttctaaacgttaatggagaaaattgaaggtggtaaaatgtcatgtttattcaggctgggaactgtattcacagtagaagtttcagtggtcaacatatctatgactctttaggctgctgtagttttacagtcaattatttaaaagtgagtagttacatttataagagcctgagaatacttagactcagtcatttgttagtatttttaccaaaatctcttagtttcagacatgtcagaagcagctatatagcatatcttattctatgatatacatcaggctatctcaagttcctgtctcacagttaattcaaagaaggattaggatttctgtattttttctcatttgaatctttatgtgcatttggtttgtgtacatgctttttgtagtgtaagatatgaaattttatattttttcagaaaataaaaaccctttgaatacagtta

SEQ ID NO: 9630 - DNA, 3427 bp, Homo sapiens
gaggagccagaagcaaacttcagctgtctcagccggatccgtggttcctacatttggaggagccgcgtgccagaaggcgtaggaccccaaggggggacaaggaggactcccgagtctcccttcgccgctctgcgaggccgaagcggtggactgagccgctcgggacagcggcaccggaggaggctcggagaagatgcggggctcggggccccggggtgcgggacgccggcggcccccaagcggcggcggcgacacccccatcaccccagcgtccctggccggctgctactctgcacctcgacgggctcccctctggacgtgccttctcctgtgcgccgcactccggaccctcctggccagccccagcaacgaagtgaatttattggattcacgcactgtcatgggggacctgggatggattgcttttccaaaaaatgggtgggaagagattggtgaagtggatgaaaattatgcccctatccacacataccaagtatgcaaagtgatggaacagaatcagaataactggcttttgaccagttggatctccaatgaaggtgcttccagaatcttcatagaactcaaatttaccctgcgggactgcaacagccttcctggaggactggggacctgtaaggaaacctttaatatgtattactttgagtcagatgatcagaatgggagaaacatcaaggaaaaccaatacatcaaaattgataccattgctgccgatgaaagctttacagaacttgatcttggtgaccgtgttatgaaactgaatacagaggtcagagatgtaggacctctaagcaaaaagggattttatcttgcttttcaagatgttggtgcttgcattgctctggtttctgtgcgtgtatactataaaaaatgcccttctgtggtacgacacttggctgtcttccctgacaccatcactggagctgattcttcccaattgctcgaagtgtcaggctcctgtgtcaaccattctgtgaccgatgaacctcccaaaatgcactgcagcgccgaaggggagtggctggtgcccatcgggaaatgcatgtgcaaggcaggatatgaagagaaaaatggcacctgtcaagtgtgcagacctgggttcttcaaagcctcacctcacatccagagctgcggcaaatgtccacctcacagttatacccatgaggaagcttcaacctcttgtgtctgtgaaaaggattatttcaggagagagtctgatccacccacaatggcatgcacaagacccccctctgctcctcggaatgccatctcaaatgttaatgaaactagtgtctttctggaatggattccgcctgctgacactggtggaaggaaagacgtgtcatattatattgcatgcaagaagtgcaactcccatgcaggtgtgtgtgaggagtgtggcggtcatgtcaggtaccttccccggcaaagcggcctgaaaaacacctctgtcatgatggtggatctactcgctcacacaaactatacctttgagattgaggcagtgaatggagtgtccgacttgagcccaggagcccggcagtatgtgtctgtaaatgtaaccacaaatcaagcagctccatctccagtcaccaatgtgaaaaaagggaaaattgcaaaaaacagcatctctttgtcttggcaagaaccagatcgtcccaatggaatcatcctagagtatgaaatcaagtattttgaaaaggaccaagagaccagctacacgattatcaaatctaaagagacaactattactgcagagggcttgaaaccagcttcagtttatgtcttccaaattcgagcacgtacagcagcaggctatggtgtcttcagtcgaagatttgagtttgaaaccaccccagtgtttgcagcatccagcgatcaaagccagattcctgtaattgctgtgtctgtgacagtgggagtcattttgttggcagtggttatcggcgtcctcctcagtggaaggcggtgtggctacagcaaagcaaaacaagatccagaagaggaaaagatgcattttcataatgggcacattaaactgccaggagtaagaacttacattgatccacatacctatgaggatcccaatcaagctgtccacgaatttgctaaggagatagaagcatcatgtatcaccattgagagagttattggagcaggtgaatttggtgaagtttgtagtggacgtttgaaactaccaggaaaaagagaattacctgtggctatcaaaacccttaaagtaggctatactgaaaagcaacgcagagatttcctaggtgaagcaagtatcatgggacagtttgatcatcctaacatcatccatttagaaggtgtggtgaccaaaagtaaaccagtgatgatcgtgacagagtatatggagaatggctctttagatacatttttgaagaaaaacgatgggcagttcactgtgattcagcttgttggcatgctgagaggtatctctgcaggaatgaagtacctttctgacatgggctatgtgcatagagatcttgctgccagaaacatcttaatcaacagtaaccttgtgtgcaaagtgtctgactttggactttcccgggtactggaagatgatcccgaggcagcctacaccacaaggggaggaaaaattccaatcagatggactgccccagaagcaatagctttccgaaagtttacttctgccagtgatgtctggagttatggaatagtaatgtgggaagttgtgtcttatggagagagaccctactgggagatgaccaatcaagatgtgattaaagcggtagaggaaggctatcgtctgccaagccccatggattgtcctgctgctctctatcagttaatgctggattgctggcagaaagagcgaaatagcaggcccaagtttgatgaaatagtcaacatgttggacaagctgatacgtaacccaagtagtctgaagacgctggttaatgcatcctgcagagtatctaatttattggcagaacatagcccactaggatctggggcctacagatcagtaggtgaatggctagaggcaatcaagatgggccggtatacagagattttcatggaaaatggatacagttcaatggacgctgtggctcaggtgaccttggaggatttgagacggcttggagtgactcttgtcggtcaccagaagaagatcatgaacagccttcaagaaatgaaggtgcagctggtaaacggaatggtgccattgtaacttcatgtaaatgtcgcttcttcaagtgaatgattctgcactttgtaaacagcactgagatttattttaacaaaaaaagggggaaaagggaaaacagtgatttctaaaccttagaaaacatttgcctcagccacagaatttgtaatcatggttttactgaagtatccagttcttagtccttagtct

SEQ ID NO: 9631 - DNA, 5176 bp, Homo sapiens
ccagacacagcaggagcgcgccttggcggtgcagtttcaacctcgacttcgcagccgcgcacacaccgcctgctccccgagcagcgggaaccgcagcagctcctgggccgccgcagcgcagctccgcgctcctaccggccggcagccgtcagtccctcccctcttcagcactcagcccgcagctatttccttctgccagtctctttgaactctggatctttgcttttgctcgctgctctcctgtttttcattctccacattttctcaagtcctctttctttatccttagccaccctgcttttttcctccttttttaaaaaatcggagatttcgtcttaaaatgatttgccttccttaccttcgtccatttcaacactgaaggctgcaaagaaccttcacctttcccctagtggtatttaaaaattctcaatccgtaaaaagtctttttgaaaggcaaaggaacaggacccaggaccctctcgacacccttgatccgagtccagatctgcactagcaaccagaactaatatttcatttaaccccaccaaagggggaggcgagaggagccagaagcaaacttcagctgtctcagccggatccgtggttcctacatttggaggagccgcgtgccagaaggcgtaggaccccaaggggggacaaggaggactcccgagtctcccttcgccgctctgcgaggccgaagcggtggactgagccgctcgggacagcggcaccggaggaggctcggagaagatgcggggctcggggccccggggtgcgggacgccggcggcccccaagcggcggcggcgacacccccatcaccccagcgtccctggccggctgctactctgcacctcgacgggctcccctctggacgtgccttctcctgtgcgccgcactccggaccctcctggccagccccagcaacgaagtgaatttattggattcacgcactgtcatgggggacctgggatggattgcttttccaaaaaatgggtgggaagagattggtgaagtggatgaaaattatgcccctatccacacataccaagtatgcaaagtgatggaacagaatcagaataactggcttttgaccagttggatctccaatgaaggtgcttccagaatcttcatagaactcaaatttaccctgcgggactgcaacagccttcctggaggactggggacctgtaaggaaacctttaatatgtattactttgagtcagatgatcagaatgggagaaacatcaaggaaaaccaatacatcaaaattgataccattgctgccgatgaaagctttacagaacttgatcttggtgaccgtgttatgaaactgaatacagaggtcagagatgtaggacctctaagcaaaaagggattttatcttgcttttcaagatgttggtgcttgcattgctctggtttctgtgcgtgtatactataaaaaatgcccttctgtggtacgacacttggctgtcttccctgacaccatcactggagctgattcttcccaattgctcgaagtgtcaggctcctgtgtcaaccattctgtgaccgatgaacctcccaaaatgcactgcagcgccgaaggggagtggctggtgcccatcgggaaatgcatgtgcaaggcaggatatgaagagaaaaatggcacctgtcaagtgtgcagacctgggttcttcaaagcctcacctcacatccagagctgcggcaaatgtccacctcacagttatacccatgaggaagcttcaacctcttgtgtctgtgaaaaggattatttcaggagagagtctgatccacccacaatggcatgcacaagacccccctctgctcctcggaatgccatctcaaatgttaatgaaactagtgtctttctggaatggattccgcctgctgacactggtggaaggaaagacgtgtcatattatattgcatgcaagaagtgcaactcccatgcaggtgtgtgtgaggagtgtggcggtcatgtcaggtaccttccccggcaaagcggcctgaaaaacacctctgtcatgatggtggatctactcgctcacacaaactatacctttgagattgaggcagtgaatggagtgtccgacttgagcccaggagcccggcagtatgtgtctgtaaatgtaaccacaaatcaagcagctccatctccagtcaccaatgtgaaaaaagggaaaattgcaaaaaacagcatctctttgtcttggcaagaaccagatcgtcccaatggaatcatcctagagtatgaaatcaagtattttgaaaaggaccaagagaccagctacacgattatcaaatctaaagagacaactattactgcagagggcttgaaaccagcttcagtttatgtcttccaaattcgagcacgtacagcagcaggctatggtgtcttcagtcgaagatttgagtttgaaaccaccccagtgtcagttgcagcatccagcgatcaaagccagattcctgtaattgctgtgtctgtgacagtgggagtcattttgttggcagtggttatcggcgtcctcctcagtggaagttgctgcgaatgtggctgtgggagggcttcttccctgtgcgctgttgcccatccaagcctaatatggcggtgtggctacagcaaagcaaaacaagatccagaagaggaaaagatgcattttcataatgggcacattaaactgccaggagtaagaacttacattgatccacatacctatgaggatcccaatcaagctgtccacgaatttgctaaggagatagaagcatcatgtatcaccattgagagagttattggagcaggtgaatttggtgaagtttgtagtggacgtttgaaactaccaggaaaaagagaattacctgtggctatcaaaacccttaaagtaggctatactgaaaagcaacgcagagatttcctaggtgaagcaagtatcatgggacagtttgatcatcctaacatcatccatttagaaggtgtggtgaccaaaagtaaaccagtgatgatcgtgacagagtatatggagaatggctctttagatacatttttgaagaaaaacgatgggcagttcactgtgattcagcttgttggcatgctgagaggtatctctgcaggaatgaagtacctttctgacatgggctatgtgcatagagatcttgctgccagaaacatcttaatcaacagtaaccttgtgtgcaaagtgtctgactttggactttcccgggtactggaagatgatcccgaggcagcctacaccacaaggggaggaaaaattccaatcagatggactgccccagaagcaatagctttccgaaagtttacttctgccagtgatgtctggagttatggaatagtaatgtgggaagttgtgtcttatggagagagaccctactgggagatgaccaatcaagatgtgattaaagcggtagaggaaggctatcgtctgccaagccccatggattgtcctgctgctctctatcagttaatgctggattgctggcagaaagagcgaaatagcaggcccaagtttgatgaaatagtcaacatgttggacaagctgatacgtaacccaagtagtctgaagacgctggttaatgcatcctgcagagtatctaatttattggcagaacatagcccactaggatctggggcctacagatcagtaggtgaatggctagaggcaatcaagatgggccggtatacagagattttcatggaaaatggatacagttcaatggacgctgtggctcaggtgaccttggagtgagtaatttttctgataatttttacataattgctggggcaagaaaaattgttcaaaaaccaatctggatgaggtaagggaaatcagttaacctttgcggatgtgtggcagctctcaaagaagcctcatcatctttagcctgtattgttaacaactgcatggttaatgctacatgtggccagtatctttgcttctttgcttcaaacaaataacattggcatacttgaataattggaataacagctccttggcaaaatactggtgttttgtgttgtggaaaagatgttttcttgacaagtttttttatactggtatctatgttatatgaatgtaaatacaaaacaaaataaactgtaagcacaattggtgtggctagtcctacataaggaccaaacatatttgtacattttggctctctacgatgaatatcaaggtaacagtagcttaaacaaagcttccctggcaggatctcatttaatttctaaatggtgcaccttacattctttcaatctaaggatgtatcagatcccgcctctgatttgttatttggtacaatctcagtggaaccaattgtgcccttttctgtttgcacgtttaagataaaatttatcaaaccttattaaataaaaatcactagagttaaatattaagttctttaaggttgtaagttgtttgtattttattatatactctgtacatgtggttgttttagcctaattgttatttgtgaaaattaactgtctttatggtggttccatctagattacattaacattaatgttttaacctgtgaatataatgataacttacttcaaattacctgccaattcaaaggttaaaatattgtaaggtttagaaaatggtagaatattctgaagcactaaaccatagttgttattttatttgtacacatgatatgaacattgagcagttcttgctcacccatctctattattctgacattctttgattcattgaattcattgttcctccccacagaaggtaacagggtaccaccatttatcaccaattaatgtcacattctcagcattctcttccttcataccgataactaaaaggacctgaaaccaaccactcagcttgctttctaaatttactgaatctcattctcacggtccaccagatcatatctacttgataacacatatgctttgtccattatttctttggacactcaaggaacccatttgtgctatatttaaactggtatactgaaaaatttactgataatttaaaactatttttacatgattgctatttaatttttcagtaaaaatggtcattttaatttattaaagtcatttgtcattttatattaaaatgatattgtaggtatttcttctacccaatgtcagattacttgtaaatatataataaaattatttgcatt

SEQ ID NO: 9632 - DNA, 4943 bp, Homo sapiens
tcccgacgcgcgggccgcagcggccaagcccgagggtgcgtggcgcccccgcccgcccggcccggcccggccatggcccccgcccggggccgcctgccccctgcgctctgggtcgtcacggccgcggcggcggcggccacctgcgtgtccgcggcgcgcggcgaagtgaatttgctggacacgtcgaccatccacggggactggggctggctcacgtatccggctcatgggtgggactccatcaacgaggtggacgagtccttccagcccatccacacgtaccaggtttgcaacgtcatgagccccaaccagaacaactggctgcgcacgagctgggtcccccgagacggcgcccggcgcgtctatgctgagatcaagtttaccctgcgcgactgcaacagcatgcctggtgtgctgggcacctgcaaggagaccttcaacctctactacctggagtcggaccgcgacctgggggccagcacacaagaaagccagttcctcaaaatcgacaccattgcggccgacgagagcttcacaggtgccgaccttggtgtgcggcgtctcaagctcaacacggaggtgcgcagtgtgggtcccctcagcaagcgcggcttctacctggccttccaggacataggtgcctgcctggccatcctctctctccgcatctactataagaagtgccctgccatggtgcgcaatctggctgccttctcggaggcagtgacgggggccgactcgtcctcactggtggaggtgaggggccagtgcgtgcggcactcagaggagcgggacacacccaagatgtactgcagcgcggagggcgagtggctcgtgcccatcggcaaatgcgtgtgcagtgccggctacgaggagcggcgggatgcctgtgtggcctgtgagctgggcttctacaagtcagcccctggggaccagctgtgtgcccgctgccctccccacagccactccgcagctccagccgcccaagcctgccactgtgacctcagctactaccgtgcagccctggacccgccgtcctcagcctgcacccggccaccctcggcaccagtgaacctgatctccagtgtgaatgggacatcagtgactctggagtgggcccctcccctggacccaggtggccgcagtgacatcacctacaatgccgtgtgccgccgctgcccctgggcactgagccgctgcgaggcatgtgggagcggcacccgctttgtgccccagcagacaagcctggtgcaggccagcctgctggtggccaacctgctggcccacatgaactactccttctggatcgaggccgtcaatggcgtgtccgacctgagccccgagccccgccgggccgctgtggtcaacatcaccacgaaccaggcagccccgtcccaggtggtggtgatccgtcaagagcgggcggggcagaccagcgtctcgctgctgtggcaggagcccgagcagccgaacggcatcatcctggagtatgagatcaagtactacgagaaggacaaggagatgcagagctactccaccctcaaggccgtcaccaccagagccaccgtctccggcctcaagccgggcacccgctacgtgttccaggtccgagcccgcacctcagcaggctgtggccgcttcagccaggccatggaggtggagaccgggaaaccccggccccgctatgacaccaggaccattgtctggatctgcctgacgctcatcacgggcctggtggtgcttctgctcctgctcatctgcaagaagaggcactgtggctacagcaaggccttccaggactcggacgaggagaagatgcactatcagaatggacaggcacccccacctgtcttcctgcctctgcatcaccccccgggaaagctcccagagccccagttctatgcggaaccccacacctacgaggagccaggccgggcgggccgcagtttcactcgggagatcgaggcctctaggatccacatcgagaaaatcatcggctctggagactccggggaagtctgctacgggaggctgcgggtgccagggcagcgggatgtgcccgtggccatcaaggccctcaaagccggctacacggagagacagaggcgggacttcctgagcgaggcgtccatcatggggcaattcgaccatcccaacatcatccgcctcgagggtgtcgtcacccgtggccgcctggcaatgattgtgactgagtacatggagaacggctctctggacaccttcctgaggacccacgacgggcagttcaccatcatgcagctggtgggcatgctgagaggagtgggtgccggcatgcgctacctctcagacctgggctatgtccaccgagacctggccgcccgcaacgtcctggttgacagcaacctggtctgcaaggtgtctgacttcgggctctcacgggtgctggaggacgacccggatgctgcctacaccaccacgggcgggaagatccccatccgctggacggccccagaggccatcgccttccgcaccttctcctcggccagcgacgtgtggagcttcggcgtggtcatgtgggaggtgctggcctatggggagcggccctactggaacatgaccaaccgggatgtcatcagctctgtggaggaggggtaccgcctgcccgcacccatgggctgcccccacgccctgcaccagctcatgctcgactgttggcacaaggaccgggcgcagcggcctcgcttctcccagattgtcagtgtcctcgatgcgctcatccgcagccctgagagtctcagggccaccgccacagtcagcaggtgcccaccccctgccttcgtccggagctgctttgacctccgagggggcagcggtggcggtgggggcctcaccgtgggggactggctggactccatccgcatgggccggtaccgagaccacttcgctgcgggcggatactcctctctgggcatggtgctacgcatgaacgcccaggacgtgcgcgccctgggcatcaccctcatgggccaccagaagaagatcctgggcagcattcagaccatgcgggcccagctgaccagcacccaggggccccgccggcacctctgatgtacagccagcagggcccaggcagccaccaagcccaccccaggtcatgccagcggcagaggacgtgaggggctggcagcaggcagggcggccccaggcctctgccctcctctcaggtgctggaggagctgaaggcttcgccacaggacctggagttatcaggggtcaggcgcctgggaaggggcctttggtggccaccctggtgaggacacctgtcccccagggcaggcaccttctcttttccagagcctggggcctccacgtcacagagtccaacagggacatcactcgcctgcctctgtgtgcgtgcatgtgtgtgtgtggtggggggtgttctcacaaggtcatgggatctcatgtgaacagtgtgtgatcaagtgtgtccaccccttcgggtctcagcatggacgtgtgcatgttatgagcgtgtgcttatccgttaaggctggaggcacatgtgggtgatggtggatgatgtgtcatgaatgaggaggtgtgtgagcagggaactcagtgtgacaccgccaggtccagcacccatgggggcgggggagaggctcacccctacgtccccccacacctggaggctggagccaggggccacttctgaactgcaccagcaccaggcccaccctcgtctctgcctgggtgagcccaccccggctgtatctcaggtctgggtcctccctctagccgaggaggccacctgcagcctccacccggctctcaccgctgcttcaacaggaaaacagggttcccggtcagtccggctggccgccttcatggaggcatcatggcagagcacatgagatgtcctcagctgggcttggctgcctggccagggccgggggctcagcagcctcctctagcctctgatgccttccctccacggcccaggtctcctcactcaaagtcccttcgccaacctttcaatgcccagccctgacacctgccctttgtcccccaggcctaggatcagggaccagaggatcctatcttctcagcacccagcccaccccttcctgtagcatatggggagactaaggcctggagagaggggtgatgccccgtcccaggttgcactgcaaccaagtgtcagagtcggggctccggcctcctgccaaggctcttgtccccatacaccatcccacaagggcgctgggggtggaagtgccctggaagcccctcccctctcacactgacctccccccttacggcccaccagggtatgtaaatatctcttttctaccatgtcagaatattttttcctcactcctgacaatgcaaaaatggtcttcaaagcacataaaaagcacccagggtgagaaagccccatcccgggggccgttggcaggcagggaagcaggaaccccaccgtgtgccccctgccagccccagagggagtggcgagcccagctgcccagccctgccccccctccccatagccagcacagctatcccgcggggacaccagcactgagccccctctccctcctgcaataattcggggagtctcagccccatccaggtgccgcggccagctctctacacctctatatattatattactatatagccgagctgttcttccttcctatggaagtcggaaacatggtcagaacacgatctgggggggggatcctgtcttcctccccaccccaccccactcttacccaatttctgggctctggatcctcacagtcatggaggcaccgtgggcctggcacttgcaaaagtgtggcccctcactctagtgtgtggtccctctcagggtcctggggatctgcctctctgtggtctccatcctgactcttgaacttacccacaataagaataaattctgcctcatcttt

SEQ ID NO: 9633 - DNA, 1802 bp, Homo sapiens
tcccgacgcgcgggccgcagcggccaagcccgagggtgcgtggcgcccccgcccgcccggcccggcccggccatggcccccgcccggggccgcctgccccctgcgctctgggtcgtcacggccgcggcggcggcggccacctgcgtgtccgcggcgcgcggcgaagtgaatttgctggacacgtcgaccatccacggggactggggctggctcacgtatccggctcatgggtgggactccatcaacgaggtggacgagtccttccagcccatccacacgtaccaggtttgcaacgtcatgagccccaaccagaacaactggctgcgcacgagctgggtcccccgagacggcgcccggcgcgtctatgctgagatcaagtttaccctgcgcgactgcaacagcatgcctggtgtgctgggcacctgcaaggagaccttcaacctctactacctggagtcggaccgcgacctgggggccagcacacaagaaagccagttcctcaaaatcgacaccattgcggccgacgagagcttcacaggtgccgaccttggtgtgcggcgtctcaagctcaacacggaggtgcgcagtgtgggtcccctcagcaagcgcggcttctacctggccttccaggacataggtgcctgcctggccatcctctctctccgcatctactataagaagtgccctgccatggtgcgcaatctggctgccttctcggaggcagtgacgggggccgactcgtcctcactggtggaggtgaggggccagtgcgtgcggcactcagaggagcgggacacacccaagatgtactgcagcgcggagggcgagtggctcgtgcccatcggcaaatgcgtgtgcagtgccggctacgaggagcggcgggatgcctgtgtggcctgtgagctgggcttctacaagtcagcccctggggaccagctgtgtgcccgctgccctccccacagccactccgcagctccagccgcccaagcctgccactgtgacctcagctactaccgtgcagccctggacccgccgtcctcagcctgcacccggccaccctcggcaccagtgaacctgatctccagtgtgaatgggacatcagtgactctggagtgggcccctcccctggacccaggtggccgcagtgacatcacctacaatgccgtgtgccgccgctgcccctgggcactgagccgctgcgaggcatgtgggagcggcacccgctttgtgccccagcagacaagcctggtgcaggccagcctgctggtggccaacctgctggcccacatgaactactccttctggatcgaggccgtcaatggcgtgtccgacctgagccccgagccccgccgggccgctgtggtcaacatcaccacgaaccaggcaggtaggcggagaaactccgtcccgcagcgtcctggtcccccagcttcccctgcctcagacccatccagggatcagagctctgccggggacgtgctgtgggcctttaggcaagtgcctctctggccctgcgctcctcaccaggacccagagctggaggctcttcattgcctttagaaaagtggaacacattctataagtaagagaaatcccaaaagctcagaggcaggctagtgtggccgtcgaaagcctaggttccagaactttccctctctgtgcctcagtttcctccctggtgcaatgggaataatagtacctgcctgaggtcctctcaggaggcttaaatgagaggaatgaaattgcttagcccagcacctggcccgtggtaaatgctcaataaatgtcattaaaaaataaaa

SEQ ID NO: 9634 - DNA, 1773 bp, Homo sapiens
gccgcagcggccaagcccgagggtgcgtggcgcccccgcccgcccggcccggccatggcccccgcccggggccgcctgccccctgcgctctgggtcgtcacggccgcggcggcggcggccacctgcgtgtccgcggcgcgcggcgaagtgaatttgctggacacgtcgaccatccacggggactggggctggctcacgtatccggctcatgggtgggactccatcaacgaggtggacgagtccttccagcccatccacacgtaccaggtttgcaacgtcatgagccccaaccagaacaactggctgcgcacgagctgggtcccccgagacggcgcccggcgcgtctatgctgagatcaagtttaccctgcgcgactgcaacagcatgcctggtgtgctgggcacctgcaaggagaccttcaacctctactacctggagtcggaccgcgacctgggggccagcacacaagaaagccagttcctcaaaatcgacaccattgcggccgacgagagcttcacaggtgccgaccttggtgtgcggcgtctcaagctcaacacggaggtgcgcagtgtgggtcccctcagcaagcgcggcttctacctggccttccaggacataggtgcctgcctggccatcctctctctccgcatctactataagaagtgccctgccatggtgcgcaatctggctgccttctcggaggcagtgacgggggccgactcgtcctcactggtggaggtgaggggccagtgcgtgcggcactcagaggagcgggacacacccaagatgtactgcagcgcggagggcgagtggctcgtgcccatcggcaaatgcgtgtgcagtgccggctacgaggagcggcgggatgcctgtgtggcctgtgagctgggcttctacaagtcagcccctggggaccagctgtgtgcccgctgccctccccacagccactccgcagctccagccgcccaagcctgccactgtgacctcagctactaccgtgcagccctggacccgccgtcctcagcctgcacccggccaccctcggcaccagtgaacctgatctccagtgtgaatgggacatcagtgactctggagtgggcccctcccctggacccaggtggccgcagtgacatcacctacaatgccgtgtgccgccgctgcccctgggcactgagccgctgcgaggcatgtgggagcggcacccgctttgtgccccagcagacaagcctggtgcaggccagcctgctggtggccaacctgctggcccacatgaactactccttctggatcgaggccgtcaatggcgtgtccgacctgagccccgagccccgccgggccgctgtggtcaacatcaccacgaaccaggcaggtaggcggagaaactccgtcccgcagcgtcctggtcccccagcttcccctgcctcagacccatccagggatcagagctctgccggggacgtgctgtgggcctttaggcaagtgcctctctggccctgcgctcctcaccaggacccagagctggaggctcttcattgcctttagaaaagtggaacacattctataagtaagagaaatcccaaaagctcagaggcaggctagtgtggccgtcgaaagcctaggttccagaactttccctctctgtgcctcagtttcctccctggtgcaatgggaataatagtacctgcctgaggtcctctcaggaggcttaaatgagaggaatgaaattgcttagcccagcacctggcccgtggtaaatgctcaataaatgtcatt

SEQ ID NO: 9635 - DNA, 4672 bp, Homo sapiens
tctggccggctccgtcctcccgtaggctccgctgtagctagcaatgtgacaccaggacgcactcgctctcgcgcgctctcccaggctcgttctccctcgccctctctctctcacacacgcacgcacacacccacctctcccataaacacacacacacacatgcacacccacacccacgcgcgcccgcaccgccccacgcgcacacactcctgcccacgcccacgcagcgctccgggaagtccggtccgggcgagagcgcgaaaggataccgagaagccacccgcggagagcgcagcggcgccctgggacgcggcgctctcccggcgctgctgcctcggcttggtctcggcctgcgggccgtcggccggcgatggccctggattatctactactgctcctcctggcatccgcagtggctgcgatggaagaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacctcaaagtagacaccattgctgcagatgagagcttctcccaggtggactttgggggaaggctgatgaaggtaaacacagaagtcaggagctttgggcctcttactcggaatggtttttacctcgcttttcaggattatggagcctgtatgtctcttctttctgtccgtgtcttcttcaaaaagtgtcccagcattgtgcaaaattttgcagtgtttccagagactatgacaggggcagagagcacatctctggtgattgctcggggcacatgcatccccaacgcagaggaagtggacgtgcccatcaaactctactgcaacggggatggggaatggatggtgcctattgggcgatgcacctgcaagcctggctatgagcctgagaacagcgtggcatgcaaggcttgccctgcagggacattcaaggccagccaggaagctgaaggctgctcccactgcccctccaacagccgctcccctgcagaggcgtctcccatctgcacctgtcggaccggttattaccgagcggactttgaccctccagaagtggcatgcactagcgtcccatcaggtccccgcaatgttatctccatcgtcaatgagacgtccatcattctggagtggcaccctccaagggagacaggtgggcgggatgatgtgacctacaacatcatctgcaaaaagtgccgggcagaccgccggagctgctcccgctgtgacgacaatgtggagtttgtgcccaggcagctgggcctgacggagtgccgcgtctccatcagcagcctgtgggcccacaccccctacacctttgacatccaggccatcaatggagtctccagcaagagtcccttccccccacagcacgtctctgtcaacatcaccacaaaccaagccgccccctccaccgttcccatcatgcaccaagtcagtgccactatgaggagcatcaccttgtcatggccacagccggagcagcccaatggcatcatcctggactatgagatccggtactatgagaaggaacacaatgagttcaactcctccatggccaggagtcagaccaacacagcaaggattgatgggctgcggcctggcatggtatatgtggtacaggtgcgtgcccgcactgttgctggctacggcaagttcagtggcaagatgtgcttccagactctgactgacgatgattacaagtcagagctgagggagcagctgcccctgattgctggctcggcagcggccggggtcgtgttcgttgtgtccttggtggccatctctatcgtctgtagcaggaaacgggcttatagcaaagaggctgtgtacagcgataagctccagcattacagcacaggccgaggctccccagggatgaagatctacattgaccccttcacttacgaggatcccaacgaagctgtccgggagtttgccaaggagattgatgtatcttttgtgaaaattgaagaggtcatcggagcaggggagtttggagaagtgtacaaggggcgtttgaaactgccaggcaagagggaaatctacgtggccatcaagaccctgaaggcagggtactcggagaagcagcgtcgggactttctgagtgaggcgagcatcatgggccagttcgaccatcctaacatcattcgcctggagggtgtggtcaccaagagtcggcctgtcatgatcatcacagagttcatggagaatggtgcattggattctttcctcaggcaaaatgacgggcagttcaccgtgatccagcttgtgggtatgctcaggggcatcgctgctggcatgaagtacctggctgagatgaattatgtgcatcgggacctggctgctaggaacattctggtcaacagtaacctggtgtgcaaggtgtccgactttggcctctcccgctacctccaggatgacacctcagatcccacctacaccagctccttgggagggaagatccctgtgagatggacagctccagaggccatcgcctaccgcaagttcacttcagccagcgacgtttggagctatgggatcgtcatgtgggaagtcatgtcatttggagagagaccctattgggatatgtccaaccaagatgtcatcaatgccatcgagcaggactaccggctgcccccacccatggactgtccagctgctctacaccagctcatgctggactgttggcagaaggaccggaacagccggccccggtttgcggagattgtcaacaccctagataagatgatccggaacccggcaagtctcaagactgtggcaaccatcaccgccgtgccttcccagcccctgctcgaccgctccatcccagacttcacggcctttaccaccgtggatgactggctcagcgccatcaaaatggtccagtacagggacagcttcctcactgctggcttcacctccctccagctggtcacccagatgacatcagaagacctcctgagaataggcatcaccttggcaggccatcagaagaagatcctgaacagcattcattctatgagggtccagataagtcagtcaccaacggcaatggcatgagaactcttgtttcttggggaaggagaggagggaaaaggaccagggtcaagggggaccagaggttgaccactgtggaatgtactggagagactggcttctcagctgaggaatgcatttccatcagtgaagaatcaaccggacctgttgctagcaggcaatctccatttctcagtgacagaagcatgtttgagatgccgtgggaaaccaaatatataataataaaaatataaaaaggtgatgttcaacagaagtgaagacaaaacaatatgcatcaggagaacaagagtaaacccagctcccattctcagtgggctgcagttgcccaaccacaggaagaaagggaaggaggtagagggaagaaacagaagcagtgttccattttcttcctcaccaatgacattcttttcttttctcctttcgtactcctccctgagagtcccctcccttctcccacactcgtttccctttgctcatgactcctgtagggaagtttcttcaaacaaaacccagctcctgagtctccagatgttgttctgtcagttgccaaaggactttgctgaccactgcatggggatccaaccaattcaattaatgtcttcatattgaagaagagatgtaccttcaattgaaaacctcgtttttcttttgtttgcattttctgcaaaaaggaaaaagaaaccacaaattggggaaaaaaaaagaagaaaaacctgtttccgtgtgcaaaagcacacatatgtatgtctgtgttataaaatgactgtgcttgttcgtaacagatgcaaacaagaaagaagaactgggaagtctttgtccctaggaaatccaaaggggctggaatatggtgttggtttggctttctggttggcccaatcggcctattggctcaatgggaagagaggagagggagaaaaataaaatgaaaggaaaaaaaaaagtttgcaaattcagacaggaaacaggtgagtggtttgaattggatgcagtgtgggccatcctggaatgatactgactgattaattattcctgataacatctcaagaaaaggagaaggaaagtgtttctggagaatgttctttcacatcactggaatctgcaattcaagaagtgacaagggagaattcttgctttacctatggactggcttaagccgtgtggcatccgaggaatgtttcaaatgtgtctgtgtttctctttacattccttgttgtacctcattgttcaattcacttttgtaaattccacctaacatttaattattttaaatttctccttttaccttaatctccttgctaattttatctgtctaattaaaaagagcagaagcatgtctgggtttacgtaaaa

SEQ ID NO: 9636 - DNA, 2786 bp, Homo sapiens
actcccaccatccccctctaacagcacggagtcagtttccaggcagtgggcaaggagggctaagaacttgccccaggctacctgcctcccagctgaaaagggctttagttcttcccctgcctgtggagtctgcatgccagattcgcaccctcccctgagttctggccaggaggcttctgaacaagttcatattgttacaaagttcagctggagacttccttctccctgtggcattttcccagtgcctctggctgccctcctgagggatccctgtggtgccaggcaggaatttcctgcttggggaacccagtgggctcccagagcctttctcgcagcttcctctacccctgtatttcgctcggctctctaaattgactcagctccagcttgccctgcagggacattcaaggccagccaggaagctgaaggctgctcccactgcccctccaacagccgctcccctgcagaggcgtctcccatctgcacctgtcggaccggttattaccgagcggactttgaccctccagaagtggcatgcactagcgtcccatcaggtccccgcaatgttatctccatcgtcaatgagacgtccatcattctggagtggcaccctccaagggagacaggtgggcgggatgatgtgacctacaacatcatctgcaaaaagtgccgggcagaccgccggagctgctcccgctgtgacgacaatgtggagtttgtgcccaggcagctgggcctgacggagtgccgcgtctccatcagcagcctgtgggcccacaccccctacacctttgacatccaggccatcaatggagtctccagcaagagtcccttccccccacagcacgtctctgtcaacatcaccacaaaccaagccgccccctccaccgttcccatcatgcaccaagtcagtgccactatgaggagcatcaccttgtcatggccacagccggagcagcccaatggcatcatcctggactatgagatccggtactatgagaaggaacacaatgagttcaactcctccatggccaggagtcagaccaacacagcaaggattgatgggctgcggcctggcatggtatatgtggtacaggtgcgtgcccgcactgttgctggctacggcaagttcagtggcaagatgtgcttccagactctgactgacgatgattacaagtcagagctgagggagcagctgcccctgattgctggctcggcagcggccggggtcgtgttcgttgtgtccttggtggccatctctatcgtctgtagcaggaaacgggcttatagcaaagaggctgtgtacagcgataagctccagcattacagcacaggccgaggctccccagggatgaagatctacattgaccccttcacttacgaggatcccaacgaagctgtccgggagtttgccaaggagattgatgtatcttttgtgaaaattgaagaggtcatcggagcaggggagtttggagaagtgtacaaggggcgtttgaaactgccaggcaagagggaaatctacgtggccatcaagaccctgaaggcagggtactcggagaagcagcgtcgggactttctgagtgaggcgagcatcatgggccagttcgaccatcctaacatcattcgcctggagggtgtggtcaccaagagtcggcctgtcatgatcatcacagagttcatggagaatggtgcattggattctttcctcaggcaaaatgacgggcagttcaccgtgatccagcttgtgggtatgctcaggggcatcgctgctggcatgaagtacctggctgagatgaattatgtgcatcgggacctggctgctaggaacattctggtcaacagtaacctggtgtgcaaggtgtccgactttggcctctcccgctacctccaggatgacacctcagatcccacctacaccagctccttgggagggaagatccctgtgagatggacagctccagaggccatcgcctaccgcaagttcacttcagccagcgacgtttggagctatgggatcgtcatgtgggaagtcatgtcatttggagagagaccctattgggatatgtccaaccaagatgtcatcaatgccatcgagcaggactaccggctgcccccacccatggactgtccagctgctctacaccagctcatgctggactgttggcagaaggaccggaacagccggccccggtttgcggagattgtcaacaccctagataagatgatccggaacccggcaagtctcaagactgtggcaaccatcaccgccgtgccttcccagcccctgctcgaccgctccatcccagacttcacggcctttaccaccgtggatgactggctcagcgccatcaaaatggtccagtacagggacagcttcctcactgctggcttcacctccctccagctggtcacccagatgacatcagaagacctcctgagaataggcatcaccttggcaggccatcagaagaagatcctgaacagcattcattctatgagggtccagataagtcagtcaccaacggcaatggcatgagaactcttgtttcttggggaaggagaggagggaaaaggaccagggtcaagggggaccagaggttgaccactgtggaatgtactggagagactggcttctcagctgaggaatgcatttccatcagtgaagaatcaaccggacctgttgctagcaggcaatctccatttctcagtgacagaagcatgtttgagatgccgtgggaaaccaaatatataataataaaaatataaaaaggtgatgttcaacagaa

SEQ ID NO: 9637 - DNA, 4236 bp, Homo sapiens
cagcagaagtgagtacgtgagcggcgcagcaagatcccagctcggaccccggacggcgcgcgcccccgaagccccggatcccagtcgggcccgcagctgaccgccagattactgtgcatcccgaatcacgaccacctgcaccctcctgccccggcccgccccccaagtcctcaggcacccagctccccggcgccccggatcctcctggaccggtccgtccagattcccgcgggaccgacctgtccgcatccccaggaccgccgggctcggtgcaccgcctcggtcccggagccgcccgcctggattgcattccctcctctcctggatctcctgggacccgacgcgagcctgccccggagcccgccgagcgcaccctctctcgggtgcctgcagccccgccggcgcggcccggcccggcgcggcccggctcggctcctagagctgccacggccatggccagagcccgcccgccgccgccgccgtcgccgccgccggggcttctgccgctgctccctccgctgctgctgctgccgctgctgctgctgcccgccggctgccgggcgctggaagagaccctcatggacacaaaatgggtaacatctgagttggcgtggacatctcatccagaaagtgggtgggaagaggtgagtggctacgatgaggccatgaatcccatccgcacataccaggtgtgtaatgtgcgcgagtcaagccagaacaactggcttcgcacggggttcatctggcggcgggatgtgcagcgggtctacgtggagctcaagttcactgtgcgtgactgcaacagcatccccaacatccccggctcctgcaaggagaccttcaacctcttctactacgaggctgacagcgatgtggcctcagcctcctcccccttctggatggagaacccctacgtgaaagtggacaccattgcacccgatgagagcttctcgcggctggatgccggccgtgtcaacaccaaggtgcgcagctttgggccactttccaaggctggcttctacctggccttccaggaccagggcgcctgcatgtcgctcatctccgtgcgcgccttctacaagaagtgtgcatccaccaccgcaggcttcgcactcttccccgagaccctcactggggcggagcccacctcgctggtcattgctcctggcacctgcatccctaacgccgtggaggtgtcggtgccactcaagctctactgcaacggcgatggggagtggatggtgcctgtgggtgcctgcacctgtgccaccggccatgagccagctgccaaggagtcccagtgccgcccctgtccccctgggagctacaaggcgaagcagggagaggggccctgcctcccatgtccccccaacagccgtaccacctccccagccgccagcatctgcacctgccacaataacttctaccgtgcagactcggactctgcggacagtgcctgtaccaccgtgccatctccaccccgaggtgtgatctccaatgtgaatgaaacctcactgatcctcgagtggagtgagccccgggacctgggtggccgggatgacctcctgtacaatgtcatctgcaagaagtgccatggggctggaggggcctcagcctgctcacgctgtgatgacaacgtggagtttgtgcctcggcagctgggcctgacggagcgccgggtccacatcagccatctgctggcccacacgcgctacacctttgaggtgcaggcggtcaacggtgtctcgggcaagagccctctgccgcctcgttatgcggccgtgaatatcaccacaaaccaggctgccccgtctgaagtgcccacactacgcctgcacagcagctcaggcagcagcctcaccctatcctgggcacccccagagcggcccaacggagtcatcctggactacgagatgaagtactttgagaagagcgagggcatcgcctccacagtgaccagccagatgaactccgtgcagctggacgggcttcggcctgacgcccgctatgtggtccaggtccgtgcccgcacagtagctggctatgggcagtacagccgccctgccgagtttgagaccacaagtgagagaggctctggggcccagcagctccaggagcagcttcccctcatcgtgggctccgctacagctgggcttgtcttcgtggtggctgtcgtggtcatcgctatcgtctgcctcaggaagcagcgacacggctctgattcggagtacacggagaagctgcagcagtacattgctcctggaatgaaggtttatattgacccttttacctacgaggaccctaatgaggctgttcgggagtttgccaaggagatcgacgtgtcctgcgtcaagatcgaggaggtgatcggagctggggaatttggggaagtgtgccgtggtcgactgaaacagcctggccgccgagaggtgtttgtggccatcaagacgctgaaggtgggctacaccgagaggcagcggcgggacttcctaagcgaggcctccatcatgggtcagtttgatcaccccaatataatccggctcgagggcgtggtcaccaaaagtcggccagttatgatcctcactgagttcatggaaaactgcgccctggactccttcctccggctcaacgatgggcagttcacggtcatccagctggtgggcatgttgcggggcattgctgccggcatgaagtacctgtccgagatgaactatgtgcaccgcgacctggctgctcgcaacatccttgtcaacagcaacctggtctgcaaagtctcagactttggcctctcccgcttcctggaggatgacccctccgatcctacctacaccagttccctgggcgggaagatccccatccgctggactgccccagaggccatagcctatcggaagttcacttctgctagtgatgtctggagctacggaattgtcatgtgggaggtcatgagctatggagagcgaccctactgggacatgagcaaccaggatgtcatcaatgccgtggagcaggattaccggctgccaccacccatggactgtcccacagcactgcaccagctcatgctggactgctgggtgcgggaccggaacctcaggcccaaattctcccagattgtcaataccctggacaagctcatccgcaatgctgccagcctcaaggtcattgccagcgctcagtctggcatgtcacagcccctcctggaccgcacggtcccagattacacaaccttcacgacagttggtgattggctggatgccatcaagatggggcggtacaaggagagcttcgtcagtgcggggtttgcatcttttgacctggtggcccagatgacggcagaagacctgctccgtattggggtcaccctggccggccaccagaagaagatcctgagcagtatccaggacatgcggctgcagatgaaccagacgctgcctgtgcaggtctgacaccggctcccacggggaccctgaggaccgtgcagggatgccaagcagccggctggactttcggactcttggacttttggatgcctggccttaggctgtggcccagaagctggaagtttgggaaaggcccaagctgggacttctccaggcctgtgttccctccccaggaagtgcgccccaaacctcttcatattgaagatggattaggagagggggtgatgacccctccccaagcccctcagggcccagaccttcctgctctccagcaggggatccccacaacctcacacttgtctgttcttcagtgctggaggtcctggcagggtcaggctggggtaagccggggttccacagggcccagccctggcaggggtctggccccccaggtaggcggagagcagtccctccctcaggaactggaggaggggactccaggaatggggaaatgtgacaccaccatcctgaagccagcttgcacctccagtttgcacagggatttgttctgggggctgagggccctgtccccacccccgcccttggtgctgtcataaaagggcaggcaggggcaggctgaggagttgccctttgccccccagagactgactctcagagccagagatgggatgtgtgagtgtgtgtgtgtgtgtgtgtgtgtgcgcgcgcgcgcgcgtgtgtgtgtgcacgcactggcctgcacagagagcatgggtgagcgtgtaaaagcttggccctgtgccctacaatggggccagctgggccgacagcagaataaaggcaataagatgat

SEQ ID NO: 9638 - DNA, 4043 bp, Homo sapiens
ggggcgggccgggccggcttgggaggggacgcggagggggcgggccgggctgcgttcgctccagccgcggctctacagcagcgggcggcgggacccgggacccagcttggcgacggcgatctcgacgcgggcccccaggatctcccggcgccccacctctggagcagcccctgccgccagcgtcaggtccaccccggaatcccagggactctcggcgccgaacggacccgggccgggtgcaacggggtccccggactggagaagacgcgggtggcaccgtgcgagctccaggagccccgggtccactgcgaggcctcggggggcgcagacctgcagagactgcggccaacgggaagaaataaagggattatagtccacccaattcacagacttctgagactcagacacgaggagagatagagaaccgccaatctctagatcaacaagcaaaggaggtgccaagcctgtttgtcttcattgtgacactggagtctagatgctgggaagtccaagatcagggtgccggcatggtcagttcctggcgaagcctctcttctaggtttcagactgccctcttctttgttgtgtcctcgaatggcagaaaaaggggtggctgttggaggaagggaggagagtaaatgaagagaaagaactggaataaccccttgcagaaaaaaaaaaaaagggaagcaagcttagctgtacaccctgagtcttgcaaaagctgcagccccacccaggagcagggtggtggctggggcgatggtggacgccctgaagatgtcccatggctactgaaggggctgcccagttagggaacagagtggcgggcatggtgtgtagcctatgggtgctgctcctggtgtcttcagttctggctctggaagaggtattgctggacaccaccggagagacatctgagattggctggctcacctacccaccaggggggtgggacgaggtgagtgttctggacgaccagcgacgcctgactcggacctttgaggcatgtcatgtggcaggggcccctccaggcaccgggcaggacaattggttgcagacacactttgtggagcggcgcggggcccagagggcgcacattcgactccacttctctgtgcgggcatgctccagcctgggtgtgagcggcggcacctgccgggagaccttcaccctttactaccgtcaggctgaggagcccgacagccctgacagcgtttcctcctggcacctcaaacgctggaccaaggtggacacaattgcagcagacgagagctttccctcctcctcctcctcctcctcctcttcttcctctgcagcgtgggctgtgggaccccacggggctgggcagcgggctggactgcaactgaacgtcaaagagcggagctttgggcctctcacccaacgcggcttctacgtggccttccaggacacgggggcctgcctggccctggtcgctgtcaggctcttctcctacacctgccctgccgtgctccgatcctttgcttcctttccagagacgcaggccagtggggctgggggggcctccctggtggcagctgtgggcacctgtgtggctcatgcagagccagaggaggatggagtagggggccaggcaggaggcagcccccccaggctgcactgcaacggggagggcaagtggatggtagctgtcgggggctgccgctgccagcctggataccaaccagcacgaggagacaaggcctgccaagcctgcccacgggggctctataagtcttctgctgggaatgctccctgctcaccatgccctgcccgcagtcacgctcccaacccagcagcccccgtttgcccctgcctggagggcttctaccgggccagttccgacccaccagaggccccctgcactggtcctccatcggctccccaggagctttggtttgaggtgcaaggctcagcactcatgctacactggcgcctgcctcgggagctggggggtcgaggggacctgctcttcaatgtcgtgtgcaaggagtgtgaaggccgccaggaacctgccagcggtggtgggggcacttgtcaccgctgcagggatgaggtccacttcgaccctcgccagagaggcctgactgagagccgagtgttagtggggggactccgggcacacgtaccctacatcttagaggtgcaggctgttaatggggtgtctgagctcagccctgaccctcctcaggctgcagccatcaatgtcagcaccagccatgaagtgccctctgctgtccctgtggtgcaccaggtgagccgggcatccaacagcatcacggtgtcctggccgcagcccgaccagaccaatgggaacatcctggactatcagctccgctactatgaccaggcagaagacgaatcccactccttcaccctgaccagcgagaccaacactgccaccgtgacacagctgagccctggccacatctatggtttccaggtgcgggcccggactgctgccggccacggcccctacgggggcaaagtctatttccagacacttcctcaaggggagctgtcttcccagcttccggaaagactctccttggtgatcggctccatcctgggggctttggccttcctcctgctggcagccatcaccgtgctggcggtcgtcttccagcggaagcggcgtgggactggctacacggagcagctgcagcaatacagcagcccaggactcggggtgaagtattacatcgacccctccacctacgaggacccctgtcaggccatccgagaacttgcccgggaagtcgatcctgcttatatcaagattgaggaggtcattgggacaggctcttttggagaagtgcgccagggccgcctgcagccacggggacggagggagcagactgtggccatccaggccctgtgggccgggggcgccgaaagcctgcagatgaccttcctgggccgggccgcagtgctgggtcagttccagcaccccaacatcctgcggctggagggcgtggtcaccaagagccgacccctcatggtgctgacggagttcatggagcttggccccctggacagcttcctcaggcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcagggcccaagttgtttgcttcgctgggcagccccagaggtcattgcacatggaaagcatacaacatccagtgatgtctggagctttgggatactcatgtgggaagtgatgagttatggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggccttcccaggcccttctgacccctgtggccctggactttccttgtctggactcaccccaggcctggctttcagccattggactggagtgctaccaggacaacttctccaagtttggcctctgtaccttcagtgatgtggctcagctcagcctagaagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctcccgatggctgcattccctggtcctccgcctctccaccagccccctcctcattaaagggaaagaagggaatttgcaa

SEQ ID NO: 9639 - DNA, 2425 bp, Homo sapiens
atggctactgaaggggctgcccagttagggaacagagtggcgggcatggtgtctgtcgggggctgccgctgccagcctggataccaaccagcacgaggagacaaggcctgccaagcctgcccacgggggctctataagtcttctgctgggaatgctccctgctcaccatgccctgcccgcagtcacgctcccaacccagcagcccccgtttgcccctgcctggagggcttctaccgggccagttccgacccaccagaggccccctgcactggtcctccatcggctccccaggagctttggtttgaggtgcaaggctcagcactcatgctacactggcgcctgcctcgggagctggggggtcgaggggacctgctcttcaatgtcgtgtgcaaggagtgtgaaggccgccaggaacctgccagcggtggtgggggcacttgtcaccgctgcagggatgaggtccacttcgaccctcgccagagaggcctgactgagagccgagtgttagtggggggactccgggcacacgtaccctacatcttagaggtgcaggctgttaatggggtgtctgagctcagccctgaccctcctcaggctgcagccatcaatgtcagcaccagccatgaagtgccctctgctgtccctgtggtgcaccaggtgagccgggcatccaacagcatcacggtgtcctggccgcagcccgaccagaccaatgggaacatcctggactatcagctccgctactatgaccaggcagaagacgaatcccactccttcaccctgaccagcgagaccaacactgccaccgtgacacagctgagccctggccacatctatggtttccaggtgcgggcccggactgctgccggccacggcccctacgggggcaaagtctatttccagacacttcctcaaggggagctgtcttcccagcttccggaaagactctccttggtgatcggctccatcctgggggctttggccttcctcctgctggcagccatcaccgtgctggcggtcgtcttccagcggaagcggcgtgggactggctacacggagcagctgcagcaatacagcagcccaggactcggggtgaagtattacatcgacccctccacctacgaggacccctgtcaggccatccgagaacttgcccgggaagtcgatcctgcttatatcaagattgaggaggtcattgggacaggctcttttggagaagtgcgccagggccgcctgcagccacggggacggagggagcagactgtggccatccaggccctgtgggccgggggcgccgaaagcctgcagatgaccttcctgggccgggccgcagtgctgggtcagttccagcaccccaacatcctgcggctggagggcgtggtcaccaagagccgacccctcatggtgctgacggagttcatggagcttggccccctggacagcttcctcaggcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcagggcccaagttgtttgcttcgctgggcagccccagaggtcattgcacatggaaagcatacaacatccagtgatgtctggagctttgggatactcatgtgggaagtgatgagttatggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggccttcccaggcccttctgacccctgtggccctggactttccttgtctggactcaccccaggcctggctttcagccattggactggagtgctaccaggacaacttctccaagtttggcctctgtaccttcagtgatgtggctcagctcagcctagaagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctcccgatggctgcattccctggtcctccgcctctccaccagccccctcctcattaaagggaaagaagggaatttgcaa

SEQ ID NO: 9640 - DNA, 4008 bp, Homo sapiens
cggagggggcgggccgggctgcgttcgctccagccgcggctctacagcagcgggcggcgggacccgggacccagcttggcgacggcgatctcgacgcgggcccccaggatctcccggcgccccacctctggagcagcccctgccgccagcgtcaggtccaccccggaatcccagggactctcggcgccgaacggacccgggccgggtgcaacggggtccccggactggagaagacgcgggtggcaccgtgcgagctccaggagccccgggtccactgcgaggcctcggggggcgcagacctgcagagactgcggccaacgggaagaaataaagggattatagtccacccaattcacagacttctgagactcagacacgaggagagatagagaaccgccaatctctagatcaacaagcaaaggaggtgccaagcctgtttgtcttcattgtgacactggagtctagatgctgggaagtccaagatcagggtgccggcatggtcagttcctggcgaagcctctcttctaggtttcagactgccctcttctttgttgtgtcctcgaatggcagaaaaaggggtggctgttggaggaagggaggagagtaaatgaagagaaagaactggaataaccccttgcagaaaaaaaaaaaaaggcaagcttagctgtacaccctgagtcttgcaaaagctgcagccccacccaggagcagggtggtggctggggcgatggtggacgccctgaagatgtcccatggctactgaaggggctgcccagttagggaacagagtggcgggcatggtgtgtagcctatgggtgctgctcctggtgtcttcagttctggctctggaagaggtattgctggacaccaccggagagacatctgagattggctggctcacctacccaccaggggggtgggacgaggtgagtgttctggacgaccagcgacgcctgactcggacctttgaggcatgtcatgtggcaggggcccctccaggcaccgggcaggacaattggttgcagacacactttgtggagcggcgcggggcccagagggcgcacattcgactccacttctctgtgcgggcatgctccagcctgggtgtgagcggcggcacctgccgggagaccttcaccctttactaccgtcaggctgaggagcccgacagccctgacagcgtttcctcctggcacctcaaacgctggaccaaggtggacacaattgcagcagacgagagctttccctcctcctcctcctcctcctcctcttcttcctctgcagcgtgggctgtgggaccccacggggctgggcagcgggctggactgcaactgaacgtcaaagagcggagctttgggcctctcacccaacgcggcttctacgtggccttccaggacacgggggcctgcctggccctggtcgctgtcaggctcttctcctacacctgccctgccgtgctccgatcctttgcttcctttccagagacgcaggccagtggggctgggggggcctccctggtggcagctgtgggcacctgtgtggctcatgcagagccagaggaggatggagtagggggccaggcaggaggcagcccccccaggctgcactgcaacggggagggcaagtggatggtagctgtcgggggctgccgctgccagcctggataccaaccagcacgaggagacaaggcctgccaagcctgcccacgggggctctataagtcttctgctgggaatgctccctgctcaccatgccctgcccgcagtcacgctcccaacccagcagcccccgtttgcccctgcctggagggcttctaccgggccagttccgacccaccagaggccccctgcactggtcctccatcggctccccaggagctttggtttgaggtgcaaggctcagcactcatgctacactggcgcctgcctcgggagctggggggtcgaggggacctgctcttcaatgtcgtgtgcaaggagtgtgaaggccgccaggaacctgccagcggtggtgggggcacttgtcaccgctgcagggatgaggtccacttcgaccctcgccagagaggcctgactgagagccgagtgttagtggggggactccgggcacacgtaccctacatcttagaggtgcaggctgttaatggggtgtctgagctcagccctgaccctcctcaggctgcagccatcaatgtcagcaccagccatgaagtgccctctgctgtccctgtggtgcaccaggtgagccgggcatccaacagcatcacggtgtcctggccgcagcccgaccagaccaatgggaacatcctggactatcagctccgctactatgaccaggcagaagacgaatcccactccttcaccctgaccagcgagaccaacactgccaccgtgacacagctgagccctggccacatctatggtttccaggtgcgggcccggactgctgccggccacggcccctacgggggcaaagtctatttccagacacttcctcaaggggagctgtcttcccagcttccggaaagactctccttggtgatcggctccatcctgggggctttggccttcctcctgctggcagccatcaccgtgctggcggtcgtcttccagcggaagcggcgtgggactggctacacggagcagctgcagcaatacagcagcccaggactcggggtgaagtattacatcgacccctccacctacgaggacccctgtcaggccatccgagaacttgcccgggaagtcgatcctgcttatatcaagattgaggaggtcattgggacaggctcttttggagaagtgcgccagggccgcctgcagccacggggacggagggagcagactgtggccatccaggccctgtgggccgggggcgccgaaagcctgcagatgaccttcctgggccgggccgcagtgctgggtcagttccagcaccccaacatcctgcggctggagggcgtggtcaccaagagccgacccctcatggtgctgacggagttcatggagcttggccccctggacagcttcctcaggcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcagggcccaagttgtttgcttcgctgggcagccccagaggtcattgcacatggaaagcatacaacatccagtgatgtctggagctttgggatactcatgtgggaagtgatgagttatggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggccttcccaggcccttctgacccctgtggccctggactttccttgtctggactcaccccaggcctggctttcagccattggactggagtgctaccaggacaacttctccaagtttggcctctgtaccttcagtgatgtggctcagctcagcctagaagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctcccgatggctgcattccctggtcctccgcctctccaccagccccctcctcattaaagggaaagaagggaatttgcaa

SEQ ID NO: 9641 - DNA, 642 bp, Homo sapiens
atggcgcccgcgcagcgcccgctgctcccgctgctgctcctgctgttaccgctgccgccgccgcccttcgcgcgcgccgaggacgccgcccgcgccaactcggaccgctacgccgtctactggaaccgcagcaaccccaggttccacgcaggcgcgggggacgacggcgggggctacacggtggaggtgagcatcaatgactacctggacatctactgcccgcactatggggcgccgctgccgccggccgagcgcatggagcactacgtgctgtacatggtcaacggcgagggccacgcctcctgcgaccaccgccagcgcggcttcaagcgctgggagtgcaaccggcccgcggcgcccggggggccgctcaagttctcggagaagttccagctcttcacgcccttctccctgggcttcgagttccggcccggccacgagtattactacatctctgccacgcctcccaatgctgtggaccggccctgcctgcgactgaaggtgtacgtgcggccgaccaacgagaccctgtacgaggctcctgagcccatcttcaccagcaataactcgtgtagcagcccgggcggctgccgcctcttcctcagcaccatccccgtgctctggaccctcctgggttcctag

SEQ ID NO: 9642 - DNA, 1782 bp, Homo sapiens
ggagctgggaagcggagaagccgggagcgcggggctcagtcggggggcggcggcggcggcggctccggggatggcggcggctccgctgctgctgctgctgctgctcgtgcccgtgccgctgctgccgctgctggcccaagggcccggaggggcgctgggaaaccggcatgcggtgtactggaacagctccaaccagcacctgcggcgagagggctacaccgtgcaggtgaacgtgaacgactatctggatatttactgcccgcactacaacagctcgggggtgggccccggggcgggaccggggcccggaggcggggcagagcagtacgtgctgtacatggtgagccgcaacggctaccgcacctgcaacgccagccagggcttcaagcgctgggagtgcaaccggccgcacgccccgcacagccccatcaagttctcggagaagttccagcgctacagcgccttctctctgggctacgagttccacgccggccacgagtactactacatctccacgcccactcacaacctgcactggaagtgtctgaggatgaaggtgttcgtctgctgcgcctccacatcgcactccggggagaagccggtccccactctcccccagttcaccatgggccccaatgtgaagatcaacgtgctggaagactttgagggagagaaccctcaggtgcccaagcttgagaagagcatcagcgggaccagccccaaacgggaacacctgcccctggccgtgggcatcgccttcttcctcatgacgttcttggcctcctagctctgccccctcccctggggggggagagatggggcggggcttggaaggagcagggagcctttggcctctccaagggaagcctagtgggcctagacccctcctcccatggctagaagtggggcctgcaccatacatctgtgtccgccccctctaccccttccccccacgtagggcactgtagtggaccaagcacggggacagccatgggtcccgggcggccttgtggctctggtaatgtttggtaccaaacttgggggccaaaaagggcagtgctcaggactccctggcccctggtacctttccctgactcctggtgccctctccctttgtccccccagagagacatatgcccccagagagagcaaatcgaagcgtgggaggcacccccattgctctcctccaggggcagaacatggggaggggactagatgggcaaggggcagcactgcctgctgcttccttcccctgtttacagcaataagcacgtcctcctcccccactcccacttccaggattgtggtttggattgaaaccaagtttacaagtagacacccctgggggggcgggcagtggacaaggatggcaaggggtgggcattggggtgccaggcaggcatgtacagactctatatctctatatataatgtacagacagacagagtcccttccctctttaaccccctgacctttcttgacttccccttcagcttcagaccccttccccaccaggctaggccccccacacctgggggaccccctggcccctcttttgtcttctgtgaagacaggacctatgcaacgcacagacacttttggagaccgtaaaacaacaacgccccctcccttccagccctgagccgggaaccatctcccaggaccttgccctgctcaccctatgtggtcccacctatcctcctgggcctttttcaagtgctttggctgtgactttcatactctgctcttagtctaaaaaaaataaactggagataaaaataa

SEQ ID NO: 9643 - DNA, 1035 bp, Homo sapiens
agtcggggggcggcggcggcggcggctccggggatggcggcggctccgctgctgctgctgctgctgctcgtgcccgtgccgctgctgccgctgctggcccaagggcccggaggggcgctgggaaaccggcatgcggtgtactggaacagctccaaccagcacctgcggcgagagggctacaccgtgcaggtgaacgtgaacgactatctggatatttactgcccgcactacaacagctcgggggtgggccccggggcgggaccggggcccggaggcggggcagagcagtacgtgctgtacatggtgagccgcaacggctaccgcacctgcaacgccagccagggcttcaagcgctgggagtgcaaccggccgcacgccccgcacagccccatcaagttctcggagaagttccagcgctacagcgccttctctctgggctacgagttccacgccggccacgagtactactacatctccacgcccactcacaacctgcactggaagtgtctgaggatgaaggtgttcgtctgctgcgcctccaaagactttgagggagagaaccctcaggtgcccaagcttgagaagagcatcagcgggaccagccccaaacgggaacacctgcccctggccgtgggcatcgccttcttcctcatgacgttcttggcctcctagctctgccccctcccctggggggggagagatggggcggggcttggaaggagcagggagcctttggcctctccaagggaagcctagtgggcctagacccctcctcccatggctagaagtggggcctgcaccatacatctgtgtccgccccctctaccccttccccccacgtagggcactgtagtggaccaagcacggggacagccatgggtcccgggcggccttgtggctctggtaatgtttggtaccaaacttgggggccaaaaagggcagtgctcaggactccctggcccctggtacctttccctgactcctggtgccctctccctttgtccccccagagagacatatgcccccagagagagc

SEQ ID NO: 9644 - DNA, 1037 bp, Homo sapiens
actttgtacctttctctcctcgactgtgaagcgggccgggacctgccaggccagaccaaaccggacctcgggggcgatgcggctgctgcccctgctgcggactgtcctctgggccgcgttcctcggctcccctctgcgcgggggctccagcctccgccacgtagtctactggaactccagtaaccccagcctgcggcgagagggctacaccgtgcaggtgaacgtgaacgactatctggatatttactgcccgcactacaacagctcgggggtgggccccggggcgggaccggggcccggaggcggggcagagcagtacgtgctgtacatggtgagccgcaacggctaccgcacctgcaacgccagccagggcttcaagcgctgggagtgcaaccggccgcacgccccgcacagccccatcaagttctcggagaagttccagcgctacagcgccttctctctgggctacgagttccacgccggccacgagtactactacatctccacgcccactcacaacctgcactggaagtgtctgaggatgaaggtgttcgtctgctgcgcctccacatcgcactccggggagaagccggtccccactctcccccagttcaccatgggccccaatgtgaagatcaacgtgctggaagactttgagggagagaaccctcaggtgcccaagcttgagaagagcatcagcgggaccagccccaaacgggaacacctgcccctggccgtgggcatcgccttcttcctcatgacgttcttggcctcctagctctgccccctcccctggggggggagagatggggcggggcttggaaggagcagggagcctttggcctctccaagggaagcctagtgggcctagacccctcctcccatggctagaagtggggcctgcaccatacatctgtgtccgccccctctaccccttccccccacgtagggcactgtagtggaccaagcacggggacagccatgggtcccgggcggccttgtggctctggtaatgtttggtaccaaacttgggggcc

SEQ ID NO: 9645 - DNA, 1096 bp, Homo sapiens
cttccctcttcactttgtacctttctctcctcgactgtgaagcgggccgggacctgccaggccagaccaaaccggacctcgggggcgatgcggctgctgcccctgctgcggactgtcctctgggccgcgttcctcggctcccctctgcgcgggggctccagcctccgccacgtagtctactggaactccagtaaccccaggttgcttcgaggagacgccgtggtggagctgggcctcaacgattacctagacattgtctgcccccactacgaaggcccagggccccctgagggccccgagacgtttgctttgtacatggtggactggccaggctatgagtcctgccaggcagagggcccccgggcctacaagcgctgggtgtgctccctgccctttggccatgttcaattctcagagaagattcagcgcttcacacccttctccctcggctttgagttcttacctggagagacttactactacatctcggtgcccactccagagagttctggccagtgcttgaggctccaggtgtctgtctgctgcaaggagaggaaccttccctctcatcccaaggagccagagtcctcccaagatcccctggaggaggagggatccctgctgcctgcactgggggtgccaattcagaccgacaagatggagcattgatgggggagatcagagggtctgaggtgactcttgcaggagcctgtcccctcatcacaggctaaagaagagcagtagacagccctggacactctgaagcagaggcaagacaaacacaggcgctttgcaggctgctctgagggtctcagcccatcccccaggaggactgggatttggtatgatcaaatcctcaagccagctgggggcccaggctgaagacctggggacaggtcgattgctggaccagggcaaagaagaagccctgccatctgtgccctgtgggccttttccctggggcagcaccttgccctccccaggggatcactcacttgtcttctatgaagacggactcttcatgaggttgaatttcatgccagtttgtatttttataagtatctagaccaaaccttcaataaaccactcatctttt

SEQ ID NO: 9646 - DNA, 1263 bp, Homo sapiens
ccgcaacttccctcttcactttgtacctttctctcctcgactgtgaagcgggccgggacctgccaggccagaccaaaccggacctcgggggcgatgcggctgctgcccctgctgcggactgtcctctgggccgcgttcctcggctcccctctgcgcgggggctccagcctccgccacgtagtctactggaactccagtaaccccaggttgcttcgaggagacgccgtggtggagctgggcctcaacgattacctagacattgtctgcccccactacgaaggcccagggccccctgagggccccgagacgtttgctttgtacatggtggactggccaggctatgagtcctgccaggcagagggcccccgggcctacaagcgctgggtgtgctccctgccctttggccatgttcaattctcagagaagattcagcgcttcacacccttctccctcggctttgagttcttacctggagagacttactactacatctcggtgcccactccagagagttctggccagtgcttgaggctccaggtgtctgtctgctgcaaggagaggaagtctgagtcagcccatcctgttgggagccctggagagagtggcacatcagggtggcgagggggggacactcccagccccctctgtctcttgctattactgctgcttctgattcttcgtcttctgcgaattctgtgagccaagcagaccttccctctcatcccaaggagccagagtcctcccaagatcccctggaggaggagggatccctgctgcctgcactgggggtgccaattcagaccgacaagatggagcattgatgggggagatcagagggtctgaggtgactcttgcaggagcctgtcccctcatcacaggctaaagaagagcagtagacagccctggacactctgaagcagaggcaagacaaacacaggcgctttgcaggctgctctgagggtctcagcccatcccccaggaggactgggatttggtatgatcaaatcctcaagccagctgggggcccaggctgaagacctggggacaggtcgattgctggaccagggcaaagaagaagccctgccatctgtgccctgtgggccttttccctggggcagcaccttgccctccccaggggatcactcacttgtcttctatgaagacggactcttcatgaggttgaatttcatgccagtttgtatttttataagtatctagaccaaaccttcaataaaccactcatctttttgttgccctccccaa

SEQ ID NO: 9647 - DNA, 1052 bp, Homo sapiens
ctctcctcgactgtgaagcgggccgggacctgccaggccagaccaaaccggacctcgggggcgatgcggctgctgcccctgctgcggactgtcctctgggccgcgttcctcggctcccctctgcgcgggggctccagcctccgccacgtagtctactggaactccagtaaccccaggttgcttcgaggagacgccgtggtggagctgggcctcaacgattacctagacattgtctgcccccactacgaaggcccagggccccctgagggccccgagacgtttgctttgtacatggtggactggccaggctatgagtcctgccaggcagagggcccccgggcctacaagcgctgggtgtgctccctgccctttggccatgttcaattctcagagaagattcagcgcttcacacccttctccctcggctttgagttcttacctggagagacttactactacatctcggtgcccactccagagagttctggccagtgcttgaggctccaggtgtctgtctgctgcaaggagaggagagccagagtcctcccaagatcccctggaggaggagggatccctgctgcctgcactgggggtgccaattcagaccgacaagatggagcattgatgggggagatcagagggtctgaggtgactcttgcaggagcctgtcccctcatcacaggctaaagaagagcagtagacagccctggacactctgaagcagaggcaagacaaacacaggcgctttgcaggctgctctgagggtctcagcccatcccccaggaggactgggatttggtatgatcaaatcctcaagccagctgggggcccaggctgaagacctggggacaggtcgattgctggaccagggcaaagaagaagccctgccatctgtgccctgtgggccttttccctggggcagcaccttgccctccccaggggatcactcacttgtcttctatgaagacggactcttcatgaggttgaatttcatgccagtttgtatttttataagtatctagaccaaaccttcaataaaccactcatctttt

SEQ ID NO: 9648 - DNA, 3314 bp, Homo sapiens
gcacagcggcagcggagggagtctatgcgagctggacagcagtgggaggtttgtgaggctcgcactggccgcagaccctcgggctcgatcgcccgggagccaggactcggcgacgcgaggctgccgggctacccggccgaggcttcgggggcgcaaactaatgggactggctcgctcggcagcatctccccgctcttctaagtacactgagcagggcccgcgctgaagtagaagctgtccgggggcgcgtagcccggagtcccagtgtggcccggaggaacggagcccgtgccagggcggcccagtcgggagcccggggaccgagcttgtgctgtggggaaacccccacttcttccaagggacagcgatcccgggacggtcgaggcgtcggggcggtcaccgagacctctgcgggaagaccccgtcggggagagggcgcgcagccccgaagcgtctcgggaagtcgagcggaatcgggcgggatcacccgggggcgcagagcccccgtcgcgcctcgtgcggcagcggagagcccaggagaacgagccctcgggggccgaagcccatgcccgggttgggggcggctgcccagtgagtcctcctggccggccgggcggagaagagcgacaccgaagccggcgggaggggagcacttcaaggccggcggctgcggaggatgggcgcctgagcggctccgagcgcagcgcggcagaggaaggcgaggcgagctttggtgaggaggcgccaagggatcccgaagtgcagtctgcccccgggaagatggctcggcctgggcagcgttggctcggcaagtggcttgtggcgatggtcgtgtgggcgctgtgccggctcgccacaccgctggccaagaacctggagcccgtatcctggagctccctcaaccccaagttcctgagtgggaagggcttggtgatctatccgaaaattggagacaagctggacatcatctgcccccgagcagaagcagggcggccctatgagtactacaagctgtacctggtgcggcctgagcaggcagctgcctgtagcacagttctcgaccccaacgtgttggtcacctgcaataggccagagcaggaaatacgctttaccatcaagttccaggagttcagccccaactacatgggcctggagttcaagaagcaccatgattactacattacctcaacatccaatggaagcctggaggggctggaaaaccgggagggcggtgtgtgccgcacacgcaccatgaagatcatcatgaaggttgggcaagatcccaatgctgtgacgcctgagcagctgactaccagcaggcccagcaaggaggcagacaacactgtcaagatggccacacaggcccctggtagtcggggctccctgggtgactctgatggcaagcatgagactgtgaaccaggaagagaagagtggcccaggtgcaagtgggggcagcagcggggaccctgatggcttcttcaactccaaggtggcattgttcgcggctgtcggtgccggttgcgtcatcttcctgctcatcatcatcttcctgacggtcctactactgaagctacgcaagcggcaccgcaagcacacacagcagcgggcggctgccctctcgctcagtaccctggccagtcccaaggggggcagtggcacagcgggcaccgagcccagcgacatcatcattcccttacggactacagagaacaactactgcccccactatgagaaggtgagtggggactacgggcaccctgtctacatcgtccaagagatgccgccccagagcccggcgaacatctactacaaggtctgagtgcccggcacggcctcaggcccccgagggacagtcggcctggaccggacctctcctttcgcccccacaccccctccccttgccagctgtgcccacctttgtatttagttttgtagtttcttggcttttataatccccctttttccctgccccctgggcttcggaggggggtgcttgtgcccctaacccccatgctcttgtgccttccccctctggccaggcctctgggctccgtgggggcgccccttcttggaaggcagggctggacactgatggacagcaggcagggagacagtcccctggccctgcccctccctcgccccccttgccaccttcccaggactgcttgtccgctatcatcactgtttttaatgcttttgtgttcattttttagctgtcaactcattttcatctgttttttgaagaaaaatggaaaaatgtaaaaggcagcccctccccaggctttgtgagcctggcccaagccagtacaagagggcctggggcacgatgtggtcagccaggaagcataggatgccatttcttttatagattccttggtatttctggtggggtaaggggcaggccagggctgttcacgcccatgagggaagaggaaagtgccactgggcaaggtgtcccaccctcccctcctgaccctcctacgaggcttatcctggcaatggggtagtcactgccacccttccacacacacacacacacacacacacacaaaaaaaaatcccttccttgtgggattcttgggcatctcctgcctccctcactctcacggtaattaatgtcttaattggctgttgcctggggaacaggagagctgctgcaggcagatgacctcatggggggtggagggaggtgaggtgcccaggtggctatttgccctgcagagctgggagtttcacccccaccccccaccctgttctctccttacctttggcatcctttggcctggtggggaaacagaggcccagggtggagacctaagcgggtataagaccaggtggcctgctccttttctgggccctagcacaggtgggtaacccccacccaacccagctcctgctgctgtcccagtcttgggctggggcctggaaagaggaagaggctgcctggggctgggccagcccgctgtgcactttgaccccagttccttgccagcacggctgctaacagactgccacttgagtgcgccttgcaggcactcccagagcagccatggaaggagctggccctcacaccatccacctccacactgcctcctggccagctgcccaccccagtgccaggtgggagagggagcagaacagccagccccttccaggtggcagtcggaagggtttttgtttttgtttctgttgccatttgtgtaaatactagtctttttggaaaaaaaataatgtaaagatgttttgtataaactctgaattattttcttgttgcttttttcttagaaaaaaatgagaactaaaaaaaaaaaa

SEQ ID NO: 9649 - DNA, 3222 bp, Homo sapiens
ggtttcctcccttagcccgctgccctcaatcccagcgaggctggggctccggctcggcgcccccttcctcgctccctggtccggcgccccatgccgcccccgcccggtccccggctcccccagtcccccacttaggcgggctcacagatcccggggtgctggcgcgtgggccgggggcgcgtagggcgcctgcagacggcccctggaagggctctggtggggctgagcgctctgccgcgggggcgcgggcacagcaggaagcaggtccgcgtgggcgctgggggcatcagctaccggggtggtccgggctgaagagccaggcagccaaggcagccaccccggggggtgggcgactttgggggagttggtgccccgccccccaggccttggcggggtcatggggcccccccattctgggccggggggcgtgcgagtcggggccctgctgctgctgggggttttggggctggtgtctgggctcagcctggagcctgtctactggaactcggcgaataagaggttccaggcagagggtggttatgtgctgtaccctcagatcggggaccggctagacctgctctgcccccgggcccggcctcctggccctcactcctctcctaattatgagttctacaagctgtacctggtagggggtgctcagggccggcgctgtgaggcaccccctgccccaaacctccttctcacttgtgatcgcccagacctggatctccgcttcaccatcaagttccaggagtatagccctaatctctggggccacgagttccgctcgcaccacgattactacatcattgccacatcggatgggacccgggagggcctggagagcctgcagggaggtgtgtgcctaaccagaggcatgaaggtgcttctccgagtgggacaaagtccccgaggaggggctgtcccccgaaaacctgtgtctgaaatgcccatggaaagagaccgaggggcagcccacagcctggagcctgggaaggagaacctgccaggtgaccccaccagcaatgcaacctcccggggtgctgaaggccccctgccccctcccagcatgcctgcagtggctggggcagcaggggggctggcgctgctcttgctgggcgtggcaggggctgggggtgccatgtgttggcggagacggcgggccaagccttcggagagtcgccaccctggtcctggctccttcgggaggggagggtctctgggcctggggggtggaggtgggatgggacctcgggaggctgagcctggggagctagggatagctctgcggggtggcggggctgcagatccccccttctgcccccactatgagaaggtgagtggtgactatgggcatcctgtgtatatcgtgcaggatgggcccccccagagccctccaaacatctactacaaggtatgagggctcctctcacgtggctatcctgaatccagcccttcttggggtgctcctccagtttaattcctggtttgagggacacctctaacatctcggccccctgtgcccccccagccccttcactcctcccggctgctgtcctcgtctccacttttaggattccttaggattcccactgccccacttcctgccctcccgtttggccatgggtgcccccctctgtctcagtgtccctggatcctttttccttggggaggggcacaggctcagcctcctctctgaccatgacccaggcatccttgtccccctcacccacccagagctaggggcgggaacagcccaccttttggttggcaccgccttctttctgcctctcactggttttctcttctctatctcttattctttccctctcttccgtctctaggtctgttcttcttccctagcatcctcctccccacatctcctttcaccctcttggcttcttatcctgtgcctctcccatctcctgggtgggggcatcaaagcatttctccccttagctttcagccccccttctgacctctcataccaaccactcccctcagtctgccaaaaatgggggccttatggggaaggctctgacactccaccccagctcaggccatgggcagcagggctccattctctggcctggcccaggcctctacatacttactccagccatttggggtggttgggtcatgacagctaccatgagaagaagtgtcccgttttgtccagtggccaatagcaagatatgaaccggtcgggacatgtatggacttggtctgatgctgaatgggccacttgggaccggaagtgacttgctccagacaagaggtgaccaggcccggacagaaatggcctgggaagtagcagaagcagtgcagcaggaactggaagtgccttcatccaggacaggaagtagcacttctgaaacaggaagtggtctggctggaactccaagtggcttagtctgggggatcaggaggtgggaggtggatggttcttattctgtggagaagaagggcgggaagaacttcctttcaggaggaagctggaacttactgactgtaagaggttagaggtggaccgagaaggacttttcccagtcttcagtggcacttcccaagatctcccttcccttgtgctctgtgctgattttaggacagctaagatgactgccatgtgctgtggcaggcctaatttgtcttgttctttcctttccatatcccagtataatctctgttaatcaacaggactaccccaagaacccatgtgctctcccgagtaacccagatggctgtcttgttcattccatcctacatttctgactcctttcagactcaacacagttcccttcttagtgaccaaaatggtggcctactggctggtctagctgacagtggtacttagcaaaggccactgtttccatagtgaccagctgatacctcttcctgccctctagtgtgcaattgggtgttgcctcagtttcctcccagctcagttttattagatcaaagctgttgttgggcaccaggttggccacctcaatcaccagccaagatggttgctttgtccaccagaggtcaagttcacctctctggtgctgtagttcccagctccttcctgatttttctaatcgctccttctggggaacaggaagttgatattgccatggtggcggggtatgccgtcacctcagtagttttactgtaaaagggaaatttgaacaacaaaaaccaaaaaaaataaaaataaaaaacttcaaaagttgacaagaa

SEQ ID NO: 9650 - DNA, 1773 bp, Homo sapiens
atgatggaaacaccatggctgcggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaagaattctttgttgctttgcgtcttgtggcatgtgcccagaatggattggaagtttcactaagtagtttgaacctggctgttcctccaccaagatttcatgataccagtagtcctttgctaatcagtggaacctctgcagctgagctcccatgggctgtaaaacctgaagataaggccaaatatgatgcaatatttgatagtttaagcccagtgaatggatttctgtctggtgataaagtgaaaccagtgttgctcaactctaagttacctgtggatatccttggaagagtttgggagttgagtgatattgaccatgatggaatgcttgacagagatgagtttgcagttacggagtctcactctgtcactcaggctggagtgcagtggcgggatctcagctcactgcagcctcggcctcctggattcaagttattcttccacctcagcctcctgaggagctgggattacaggcatgcaccaccacccccggctaatttttatatttttagtagagacagcgtttcgccgtgtttgccagactggtctcgagctcctgataataggtgatccactcgcctcggcctcccaaagtgccgggattacaggcatgagccacctcttcaggcccaagacaaaaatatagttagagtagatggggaatagtagtgtcatcatttgataaacagtagtgcatgctaaggtaaatgaataaacacaatttatcttatatgcctggagcctattcccaggtaactggccttttttttttttaataaaaagctttattaaaaataatttttgaataataaatacatttgtaggaaattactaccttgaattttgttttaaatagtagacacccctttatcttctcctagatttacttgttaaccattttgtcacatttgctttctccctgtatccatattcttcagaattttttcctagttttaaactctagcttgtgtgattttaatactgcttctcctgttccctctttttttgaattacctgatatttcttatgtttgttgtgtatgtctcttgaaaatggcagatttctgtattttaatgctttacctaattggatagtttttaagataatagcacttatattgatttgattttcccttctttaccgatttattttacatttttattttctctgtttcttactgttgcttattatcaacttgtgattcattcccttaccccgcctcccagttaatgtggaaattttgttataatgtcttgtttcattaatatagttaatacaggttgagcatccctaatctgaaaatccaaaacttgaaatgcttcaaaatctgaaacttttgagtactgacatgacccacaaagtggaaaattccactcctggtctcatgtgataagttacagtcaaaacttttgtttcatgcacaaaattattaaaaagattgtataaaattatcttagattatgtgtataaagtttatatgaaacataaatgaatttcatgtttagacttgggtcccatccccaagataggataatattccagaatctgg

SEQ ID NO: 9651 - DNA, 4736 bp, Homo sapiens
tggaaacaccatggctgcggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaagaattctttgttgctttgcgtcttgtggcatgtgcccagaatggattggaagtttcactaagtagtttgaacctggctgttcctccaccaagatttcatgataccagtagtcctttgctaatcagtggaacctctgcagctgagctcccatgggctgtaaaacctgaagataaggccaaatatgatgcaatatttgatagtttaagcccagtgaatggatttctgtctggtgataaagtgaaaccagtgttgctcaactctaagttacctgtggatatccttggaagagtttgggagttgagtgatattgaccatgatggaatgcttgacagagatgagtttgcagttgccatgtttttggtatactgtgcactggagaaagaacctgtgccaatgtccttgcctccagccttggtgccaccatctaagagaaaaacgtgggttgtatcccctgcagaaaaagctaaatatgatgaaatcttcctgaaaactgataaagatatggacggatttgtgtctggattggaggtccgtgaaatattcttgaaaacaggtttaccttctaccttactagcccatatatggtcattatgcgacacaaaggactgtgggaagctttcaaaggatcagtttgccttggcttttcacttaatcagtcagaagttaatcaagggcattgatcctcctcacgttcttactcctgaaatgattccaccatcagacagggccagtttacaaaagaacatcataggatcaagtcctgttgcagatttctctgctattaaggaactagatactcttaacaatgaaatagttgacctacagagggaaaagaataatgtggaacaggaccttaaggagaaggaagatactattaaacagaggacaagtgaggttcaggatcttcaagatgaagttcaaagggagaatactaatctgcaaaaactacaggcccagaaacagcaggtacaggaactccttgatgaactggatgagcagaaagcccagctggaggagcaactcaaggaagtcagaaagaaatgtgctgaggaggcccaactggcaagaagtagtcctgaactactgccttctggtgtgactgatgaaaatgaggtgactacagctgttactgaaaaagtttgttctgaactcgacaataatagacattcaaaagaggaagatccatttaatgtagactcaagttcgctgacaggtccagttgcagatacaaacttggattttttccagtctgatccttttgttggcagtgatcctttcaaggatgatccttttggaaaaatcgatccatttggtggtgatcctttcaaaggttcagatccatttgcatcagactgtttcttcaggcaatctactgatccttttgccacttcaagcactgaccctttcagtgcagccaacaatagcagtattacatcggtagaaacgttgaagcacaatgatccttttgctcctggtggaacagttgttgcagcaagcgattcagccacagacccctttgcttctgtttttgggaatgaatcatttggaggtggatttgctgacttcagcacattgtcaaaggtcaacaatgaagatccttttcgttcagccacatcgagctctgtcagcaacgtagtgattacaaaaaatgtatttgaggaaacatcggtcaaaagtgaagatgaacccccagcactgccaccaaagatcggaactccaacaagaccctgccctctaccacctgggaaaagatccatcaacaaattggattctcctgatccctttaaactgaatgatccatttcagcctttcccaggcaacgatagccccaaagaaaaagatcctgaaatattttgtgatccattcacttctgctactaccactaccaataaagaggctgatccaagcaattttgccaacttcagtgcttatccctctgaagaagatatgatcgaatgggccaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaatgtgtatcaaaactacctgtgagcatgggaatacaaaaggtttgagattcctgtaaatgtgacaaaattttaggattttttttttttcttcattacagattcgtctttttttttttttcttataaaagccgtaacccagtcagacaaattcaccttcacttaggcccctgttctggtatacatttactgtgagcttttgcctgcctgtgctattttacttgtaaagctagagcacccaagcttctgccttctggaatatagagaaatagtttcaccctgcactaccctgttctgtagttattctgatgatagccagtgaggttcttaaagtttgcagtattctcccctgattggaatggttgagtgagggtaagggaaagaatatcttatttcttttatgattggtgcaaattggctaaagtgcatttttaaatttcctctacttaatttgtttttcagagataaggaaaaatattttgcacagatttactccactatggaaaagggatgctgtaggttgaaccattatagcctcagattcgatcttttcctaactaaaaatattaaagcctcatgtgtgaaataaatttttaaaaagatttatctggatttagagaattttagatcaacagatacctctcagtgtgtttgctaattaataaaaatcagtttcttacaaataaagtttgtaagaaaatgttcattttaagtgatagatagtggagaaaatttatcacctaaaatatacccatcagtataaggcaagcaaaagtcttaacatggcagccattctgcctttgccgtggccctgtcctgtttagttcttagtgggttaatttttgtacttttgcagaagaaacttcagcaagctagaactggaaggtactttaatttttcatatatatttgtttttttttttttaatgaaggctcatttacttgaaatgtaaaaactttcactgaatacaaatagaaaaagtgatgtgttttatatcatattgctttttgtccatctttgtggtttagtttatttactcacttcatgtttttcacctataaaattgtcaagctagcaaaaaaactcttgtttttttaattgggagagaagagacctgccagattatcagacctcttcatgttaaaagaccatctcctgtaaaactgacctagtggacaagctgaatttgaaatagactgtgaagtaagctgtaacttgtcattttaattttgtttaacacggttactgacttagatgatgtattaaataccaagataaagaaaaatgcacctaaaatctaattagaattctctgggtcaacaagtcaaggtggtattgatctgtgttaatctgagtaacttattgcctagcctataaataaattccaaaatatccaattcatttcttcttgaaatggtgcttgttttgttttctttccattacacaattagactcctacagtttaaaacaaactttaaaccactatcttgcactgctaacttttttctacctttgtaaatagaaacatttctgcataaaagtcatacatatgaagcaagggctgaatcataatcacaaggcttaattttgataaacgaatccagtgacctaaggattttctgcaaaatttgactgggagttgtgataggtggtatttttgtttattttcttcctcttactccttaggataaaggtaagttgacttgaacaactttcttttgcactgggaaaataagcaaatgtttaaatgcttcaaaaaaattttcaattaaactcaaatattaaatatctataacttataaacaccaactttcaatgtaataaatgtatcctaatcttatgtatgtttaactggattacatagatttttatcttttgttaaaatgtgtataccccgtggaccaacataatattaaagtatgtatatattatataaatatatatgtatatgtgctcgcttgtgtaggatgaatgtcttagagtcgtttgtggtattttatgttgttgactctggctccagggcctgtgcttgaaaaggacagataagtattgcccagagctaagtggcactacttacaaagttttaaatgtcttctacatactgattcatgtttatttgagctctctttatagaattttctcttaaagtttcaaacctctaagttgtagcctgtaattatgagaacagtaaactttaagtaataataaagaatcccatccatatatccaatttgcaattgagttttgcatggttctctgattatgtccatgctgtgtccaaggaggagtaggtacatacaatcagcacagattaatatatgtaaagggtttgggacagcacctggtatagaataaataataaatgtaaactatta

SEQ ID NO: 9652 - DNA, 5225 bp, Homo sapiens
gccccggcctcgcctgcggccgctccctccgcctcctccccgccccgagccccagtcagcccgtcttccttcccctcccttgcatgatggaaacaccatggctgcggcggcccagctctctctgacacagttatcaagtgggaatcctgtatatgaaaaatactatagacaggttgatacaggcaatactggaagggtgttggcttctgatgctgctgctttcctgaaaaaatcagggcttccagacttgatacttggaaagatttgggatttagccgacacagatggcaaaggtatcctgaacaaacaagaattctttgttgctttgcgtcttgtggcatgtgcccagaatggattggaagtttcactaagtagtttgaacctggctgttcctccaccaagatttcatgataccagtagtcctttgctaatcagtggaacctctgcagctgagctcccatgggctgtaaaacctgaagataaggccaaatatgatgcaatatttgatagtttaagcccagtgaatggatttctgtctggtgataaagtgaaaccagtgttgctcaactctaagttacctgtggatatccttggaagagtttgggagttgagtgatattgaccatgatggaatgcttgacagagatgagtttgcagttgccatgtttttggtatactgtgcactggagaaagaacctgtgccaatgtccttgcctccagccttggtgccaccatctaagagaaaaacgtgggttgtatcccctgcagaaaaagctaaatatgatgaaatcttcctgaaaactgataaagatatggacggatttgtgtctggattggaggtccgtgaaatattcttgaaaacaggtttaccttctaccttactagcccatatatggtcattatgcgacacaaaggactgtgggaagctttcaaaggatcagtttgccttggcttttcacttaatcagtcagaagttaatcaagggcattgatcctcctcacgttcttactcctgaaatgattccaccatcagacagggccagtttacaaaagaacatcataggatcaagtcctgttgcagatttctctgctattaaggaactagatactcttaacaatgaaatagttgacctacagagggaaaagaataatgtggaacaggaccttaaggagaaggaagatactattaaacagaggacaagtgaggttcaggatcttcaagatgaagttcaaagggagaatactaatctgcaaaaactacaggcccagaaacagcaggtacaggaactccttgatgaactggatgagcagaaagcccagctggaggagcaactcaaggaagtcagaaagaaatgtgctgaggaggcccaactgatctcttctctgaaagctgaattaactagtcaggaatcgcagatctccacttacgaagaagaattggcaaaagctagagaagagctgagccgtctacagcaagaaacagcagaattggaggagagtgtagagtcagggaaggctcagttggaacctcttcagcagcacctacaagattcacaacaggaaattagttcaatgcaaatgaaactgatggaaatgaaagatttggaaaatcataatagtcagttaaattggtgcagtagcccacacagcattcttgtaaacggagctacagattattgcagcctcagcaccagcagcagtgaaacagccaaccttaatgaacatgttgaaggccagagcaacctagagtctgagcccatacaccaggaatctccagcaagaagtagtcctgaactactgccttctggtgtgactgatgaaaatgaggtgactacagctgttactgaaaaagtttgttctgaactcgacaataatagacattcaaaagaggaagatccatttaatgtagactcaagttcgctgacaggtccagttgcagatacaaacttggattttttccagtctgatccttttgttggcagtgatcctttcaaggatgatccttttggaaaaatcgatccatttggtggtgatcctttcaaaggttcagatccatttgcatcagactgtttcttcaggcaatctactgatccttttgccacttcaagcactgaccctttcagtgcagccaacaatagcagtattacatcggtagaaacgttgaagcacaatgatccttttgctcctggtggaacagttgttgcagcaagcgattcagccacagacccctttgcttctgtttttgggaatgaatcatttggaggtggatttgctgacttcagcacattgtcaaaggtcaacaatgaagatccttttcgttcagccacatcgagctctgtcagcaacgtagtgattacaaaaaatgtatttgaggaaacatcggtcaaaagtgaagatgaacccccagcactgccaccaaagatcggaactccaacaagaccctgccctctaccacctgggaaaagatccatcaacaaattggattctcctgatccctttaaactgaatgatccatttcagcctttcccaggcaacgatagccccaaagaaaaagatcctgaaatattttgtgatccattcacttctgctactaccactaccaataaagaggctgatccaagcaattttgccaacttcagtgcttatccctctgaagaagatatgatcgaatgggccaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaatgtgtatcaaaactacctgtgagcatgggaatacaaaaggtttgagattcctgtaaatgtgacaaaattttaggattttttttttttcttcattacagattcgtctttttttttttttcttataaaagccgtaacccagtcagacaaattcaccttcacttaggcccctgttctggtatacatttactgtgagcttttgcctgcctgtgctattttacttgtaaagctagagcacccaagcttctgccttctggaatatagagaaatagtttcaccctgcactaccctgttctgtagttattctgatgatagccagtgaggttcttaaagtttgcagtattctcccctgattggaatggttgagtgagggtaagggaaagaatatcttatttcttttatgattggtgcaaattggctaaagtgcatttttaaatttcctctacttaatttgtttttcagagataaggaaaaatattttgcacagatttactccactatggaaaagggatgctgtaggttgaaccattatagcctcagattcgatcttttcctaactaaaaatattaaagcctcatgtgtgaaataaatttttaaaaagatttatctggatttagagaattttagatcaacagatacctctcagtgtgtttgctaattaataaaaatcagtttcttacaaataaagtttgtaagaaaatgttcattttaagtgatagatagtggagaaaatttatcacctaaaatatacccatcagtataaggcaagcaaaagtcttaacatggcagccattctgcctttgccgtggccctgtcctgtttagttcttagtgggttaatttttgtacttttgcagaagaaacttcagcaagctagaactggaaggtactttaatttttcatatatatttgtttttttttttttaatgaaggctcatttacttgaaatgtaaaaactttcactgaatacaaatagaaaaagtgatgtgttttatatcatattgctttttgtccatctttgtggtttagtttatttactcacttcatgtttttcacctataaaattgtcaagctagcaaaaaaactcttgtttttttaattgggagagaagagacctgccagattatcagacctcttcatgttaaaagaccatctcctgtaaaactgacctagtggacaagctgaatttgaaatagactgtgaagtaagctgtaacttgtcattttaattttgtttaacacggttactgacttagatgatgtattaaataccaagataaagaaaaatgcacctaaaatctaattagaattctctgggtcaacaagtcaaggtggtattgatctgtgttaatctgagtaacttattgcctagcctataaataaattccaaaatatccaattcatttcttcttgaaatggtgcttgttttgttttctttccattacacaattagactcctacagtttaaaacaaactttaaaccactatcttgcactgctaacttttttctacctttgtaaatagaaacatttctgcataaaagtcatacatatgaagcaagggctgaatcataatcacaaggcttaattttgataaacgaatccagtgacctaaggattttctgcaaaatttgactgggagttgtgataggtggtatttttgtttattttcttcctcttactccttaggataaaggtaagttgacttgaacaactttcttttgcactgggaaaataagcaaatgtttaaatgcttcaaaaaaattttcaattaaactcaaatattaaatatctataacttataaacaccaactttcaatgtaataaatgtatcctaatcttatgtatgtttaactggattacatagatttttatcttttgttaaaatgtgtataccccgtggaccaacataatattaaagtatgtatatattatataaatatatatgtatatgtgctcgcttgtgtaggatgaatgtcttagagtcgtttgtggtattttatgttgttgactctggctccagggcctgtgcttgaaaaggacagataagtattgcccagagctaagtggcactacttacaaagttttaaatgtcttctacatactgattcatgtttatttgagctctctttatagaattttctcttaaagtttcaaacctctaagttgtagcctgtaattatgagaacagtaaactttaagtaataataaagaatcccatccatatatccaatttgcaattgagttttgcatggttctctgattatgtccatgctgtgtccaaggaggagtaggtacatacaatcagcacagattaatatatgtaaagggtttgggacagcacctggtatagaataaataataaatgtaaactatta

SEQ ID NO: 9653 - DNA, 2153 bp, Homo sapiens
tgataaataggttgaggtatggaaggatcgggctgcaacaatgattctcatggtaagggactgtttaaaatcacaacatcgcgacccacattgcgacccatctgacaaacgggaaaagaataatgtggaacaggaccttaaggagaaggaagatactattaaacagaggacaagtgaggttcaggatcttcaagatgaagttcaaagggagaatactaatctgcaaaaactacaggcccagaaacagcaggtacaggaactccttgatgaactggatgagcagaaagcccagctggaggagcaactcaaggaagtcagaaagaaatgtgctgaggaggcccaactgatctcttctctgaaagctgaattaactagtcaggaatcgcagatctccacttacgaagaagaattggcaaaagctagagaagagctgagccgtctacagcaagaaacagcagaattggaggagagtgtagagtcagggaaggctcagttggaacctcttcagcagcacctacaagattcacaacaggaaattagttcaatgcaaatgaaactgatggaaatgaaagatttggaaaatcataatagtcagttaaattggtgcagtagcccacacagcattcttgtaaacggagctacagattattgcagcctcagcaccagcagcagtgaaacagccaaccttaatgaacatgttgaaggccagagcaacctagagtctgagcccatacaccaggaatctccagcaagaagtagtcctgaactactgccttctggtgtgactgatgaaaatgaggtgactacagctgttactgaaaaagtttgttctgaactcgacaataatagacattcaaaagaggaagatccatttaatgtagactcaagttcgctgacaggtccagttgcagatacaaacttggattttttccagtctgatccttttgttggcagtgatcctttcaaggatgatccttttggaaaaatcgatccatttggtggtgatcctttcaaaggttcagatccatttgcatcagactgtttcttcaggcaatctactgatccttttgccacttcaagcactgaccctttcagtgcagccaacaatagcagtattacatcggtagaaacgttgaagcacaatgatccttttgctcctggtggaacagttgttgcagcaagcgattcagccacagacccctttgcttctgtttttgggaatgaatcatttggaggtggatttgctgacttcagcacattgtcaaaggtcaacaatgaagatccttttcgttcagccacatcgagctctgtcagcaacgtagtgattacaaaaaatgtatttgaggaaacatcggtcaaaagtgaagatgaacccccagcactgccaccaaagatcggaactccaacaagaccctgccctctaccacctgggaaaagatccatcaacaaattggattctcctgatccctttaaactgaatgatccatttcagcctttcccaggcaacgatagccccaaagaaaaagatcctgaaatattttgtgatccattcacttctgctactaccactaccaataaagaggctgatccaagcaattttgccaacttcagtgcttatccctctgaagaagatatgatcgaatgggccaagagggaaagtgagagagaggaagagcagaggcttgcccgactaaatcagcaggaacaagaagacttagaactggctattgcactcagcaaatctgagatatcagaagcatgaagaattctcttgttctttggcaacaatatagtattcttcttcctgaatactgaaactatttacaatgtgtatcaaaactacctgtgagcatgggaatacaaaaggtttgagattcctgtaaatgtgacaaaattttaggattttttttttttcttcattacagattcgtctttttttttttttcttataaaagccgtaacccagtcagacaaattcaccttcacttaggcccctgttctggtatacatttactgtgagcttttgcctgcctgtgctattttacttgtaaagctagagcacccaagcttctgccttctggaatatagagaaatagtttcaccctgcactaccctgttctgtagttattctgatgatagccagtgaggttctt

SEQ ID NO: 9654 - DNA, 4061 bp, Homo sapiens
cacttcgcctcaagcgctggagtcgaccagaactctgcggctcggctgccggcaagacccggatagcggatttcgctcctggctgcggggcgcgcactcgcccgcccgcccgctcgctcgttcctcgcgcgggcactgggcatgcgcggcgcgcggttggcactggctgcgagcgggcgggcggctccagacttcacaggcagcagctagcgaggcggtctcgcccggcgcgaggccggcgctgtgctcgcctcggagatcgctgctctttagctgggtgcagaaggcggctccgcggctcgcggacgactggctgggcgcgaatcagattggggggctttctcccggtcccctcccacctcgtctgggctcgcggcgtctccggggaaagccgtggccccgagggcggatccgagaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaacacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatcaaagaatgaactggagaattttcctttaaacacaatccagcactgccaagctgtgatgcattcatgcagctatgattcagttcttgcactggtgtgcaaagagccaacccagaacaagccagatcttcatctcttccagtgtgatgaggttaaggcaaacctaattagtgaagatattgaaagtgcaatcagtgacagtaaaggagggaaacagaagaggcggcccgacgccctgaggatgatttccaatgcagaccctagtataccgcctccacccagagctcctgcccctgcgccccctgggaccgtcacccaggtggatgttagaagtcgagtggcagcctggtctgcatgggcagccgaccaaggggactttgagaaaccaaggcagtatcatgagcaggaagaaacacctgagatgatggcagcccgcattgacagagatgtgcaaatcttaaaccacattttggatgacattgaattttttatcacaaaactccaaaaagcagcagaagcattttctgagctttctaaaaggaagaaaaacaagaaaggtaaaaggaaaggaccaggagagggtgttttaacgctgcgggcaaaacctccacctcctgatgaatttcttgactgtttccaaaagtttaaacacggatttaaccttctggccaaactgaagtctcatattcagaatcctagtgctgcagatttggttcactttttgtttactccattaaatatggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagagcattccagtgtatcagagtatcatccagccgatggctatgcgttcagtagcaacatttacacaagaggatcccacctggaccaaggggaagctgctgttgcttttaagccaacttctaatcgccatatagatagaaattatgaaccactcaaaacacaacccaagaaatatgccaaatccaagtatgactttgtagcaaggaacaacagtgagctctcggttctaaaggatgatattttagagatacttgatgatcggaagcaatggtggaaagttcgaaatgcaagtggagactctggatttgtgccaaataacattttggatattgtgagacctccagaatctggattggggcgtgctgatccaccttatactcatactatacagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattccaacatgctttgttttaagaagccttgaagggaatgtcagattcatttttcttgatgtaatttatcaccataaaaaaaaacccatgcaaacctgagtgagcacaggatttgcttctaggcccattatttttattaaaactgaaaaaatttaaactgaattttttgaccttggaaaatatttttcttactttaccaaggtgaagtttccttaattagactaattattttatccccatcccagggtataaacaggaattgttttgatagtggtggagttattcactgcaacaaagcaacaatgttgtccatgattcaaaatctaagcagtttcgattttgcctgtgaatatggtgtctgtcattcagggcatagctcactgtaggctagcctctgcttacttaagtctcttctctgacatactcaatggaagaatatttagatttatttaaagttcttaatgccaacagtttaaaaaaaaattaaaacatttgaatgaactgtaaagtacagccataccttggacatgcaaatataaatctatggagcattctcaagagagtttgtcatggctctgttgattgcaactccttgtatagcttgtattttgatttagtttatattctgcttattatgtatactgtgttcttatatatgagaaagcacaaatgcgaaagaggtcatgtcttctcaaaatctagcaaaggaagtagtctgcattggtgtgcattacagtattttgcttaatgaaagcctcagttctgaatgttgatatgagtagttaaaaggaagtggggccattttatgtgtttatctgtgtcaagtatttctggtaataagaagcacttaatttacacatattttaatcctgtgaaagattccacatagagaaaagaaagatacctaaccttcaacaaatgttatttttggaaacacaatttttgtcattaaatgttatattatttcacatatataaaacagatgttatgtaagaatgttgtatattttaacataaatcatttagagaaattatctagattcattaattttcatagtgcctttttcacatgagtcagctggaaagtctgcaataaacagtatttgctgtctgttaa

SEQ ID NO: 9655 - DNA, 543 bp, Homo sapiens
gtagaagtgacttgaagaaagagcgagaagtatagaagggcgcaggcgctagttcagtgctcgtgagcaaacaccgtctacaagattcgagtcaaacaacgtgagaacttgaaatacgtctccattctttttccttagtactctcgttcattcacttacgaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaacacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatc

SEQ ID NO: 9656 - DNA, 559 bp, Homo sapiens
agacttcacaggcagcagctagcgaggcggtctcgcccggcgcgaggccggcgctgtgctcgcctcggagatcgctgctctttagctgggtgcagaaggcggctccgcggctcgcggacgactggctgggcgcgaatcagattggggggctttctcccggtcccctcccacctcgtctgggctcgcggcgtctccggggaaagccgtggccccgagggcggatccgaggacggtcagtaaaatcttcccctgaggacattgtgattgaactgagatctgaagaatgagacagaattaactcgaagtgaccagatcttgaatattatttctttataacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaa

SEQ ID NO: 9657 - DNA, 2204 bp, Homo sapiens
aataccctgaatggtcttaagacatttattttttaatgtgaaaatttctgtctgcttttaaagcatgtagcttaaaattaatgagcccaacattgtgggttttaagcttaattacactagaattttaagaagcactctgctgtcagaactccgaaagctttattgtagtcacagtgttggaatgtataaaaattatagctctgttgcattagaacttagttgaccagcttttgagaagtaaaagcttgactgctggtttatatttctggcttgtgtaggaattaaagggtgctaagttaaggttggttctacaggtagctgactcagggaagagagagaatggggtgatattacaagttgagaaaccaaggcagtatcatgagcaggaagaaacacctgagatgatggcagcccgcattgacagagatgtgcaaatcttaaaccacattttggatgacattgaattttttatcacaaaactccaaaaagcagcagaagcattttctgagctttctaaaaggaagaaaaacaagaaaggtaaaaggaaaggaccaggagagggtgttttaacgctgcgggcaaaacctccacctcctgatgaatttcttgactgtttccaaaagtttaaacacggatttaaccttctggccaaactgaagtctcatattcagaatcctagtgctgcagatttggttcactttttgtttactccattaaatatggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagagcattccagtgtatcagagtatcatccagccgatggctatgcgttcagtagcaacatttacacaagaggatcccacctggaccaaggggaagctgctgttgcttttaagccaacttctaatcgccatatagatagaaattatgaaccactcaaaacacaacccaagaaatatgccaaatccaagtatgactttgtagcaaggaacaacagtgagctctcggttctaaaggatgatattttagagatacttgatgatcggaagcaatggtggaaagttcgaaatgcaagtggagactctggatttgtgccaaataacattttggatattgtgagacctccagaatctggattggggcgtgctgatccaccttatactcatactatacagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattccaacatgctttgttttaagaagccttgaagggaatgtcagattcatttttcttgatgtaatttatcaccat

SEQ ID NO: 9658 - DNA, 1858 bp, Homo sapiens
agtattgacaaggatgcatttcatggctgatgagcacagttttgacttgtgtatccagtggaggtgttccctttggcaaatgttgagaaaccaaggcagtatcatgagcaggaagaaacacctgagatgatggcagcccgcattgacagagatgtgcaaatcttaaaccacattttggatgacattgaattttttatcacaaaactccaaaaagcagcagaagcattttctgagctttctaaaaggaagaaaaacaagaaaggtaaaaggaaaggaccaggagagggtgttttaacgctgcgggcaaaacctccacctcctgatgaatttcttgactgtttccaaaagtttaaacacggatttaaccttctggccaaactgaagtctcatattcagaatcctagtgctgcagatttggttcactttttgtttactccattaaatatggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagagcattccagtgtatcagagtatcatccagccgatggctatgcgttcagtagcaacatttacacaagaggatcccacctggaccaaggggaagctgctgttgcttttaagccaacttctaatcgccatatagatagaaattatgaaccactcaaaacacaacccaagaaatatgccaaatccaagtatgactttgtagcaaggaacaacagtgagctctcggttctaaaggatgatattttagagatacttgatgatcggaagcaatggtggaaagttcgaaatgcaagtggagactctggatttgtgccaaataacattttggatattgtgagacctccagaatctggattggggcgtgctgatccaccttatactcatactatacagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattc

SEQ ID NO: 9659 - DNA, 2574 bp, Homo sapiens
cacttcgcctcaagcgctggagtcgaccagaactctgcggctcggctgccggcaagacccggatagcggatttcgctcctggctgcggggcgcgcactcgcccgcccgcccgctcgctcgttcctcgcgcgggcactgggcatgcgcggcgcgcggttggcactggctgcgagcgggcgggcggctccagacttcacaggcagcagctagcgaggcggtctcgcccggcgcgaggccggcgctgtgctcgcctcggagatcgctgctctttagctgggtgcagaaggcggctccgcggctcgcggacgactggctgggcgcgaatcagattggggggctttctcccggtcccctcccacctcgtctgggctcgcggcgtctccggggaaagccgtggccccgagggcggatccgagaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaacacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatcaaagaatgaactggagaattttcctttaaacacaatccagcactgccaagctgtgatgcattcatgcagctatgattcagttcttgcactggtgtgcaaagagccaacccagaacaagccagatcttcatctcttccagtgtgatgaggttaaggcaaacctaattagtgaagatattgaaagtgcaatcagtgacagtaaaggagggaaacagaagaggcggcccgacgccctgaggatgatttccaatgcagaccctagtataccgcctccacccagagctcctgcccctgcgccccctgggaccgtcacccaggtggatgttagaagtcgagtggcagcctggtctgcatgggcagccgaccaaggggactttgagaaaccaaggcagtatcatgagcaggaagaaacacctgagatgatggcagcccgcattgacagagatgtgcaaatcttaaaccacattttggatgacattgaattttttatcacaaaactccaaaaagcagcagaagcattttctgagctttctaaaaggaagaaaaacaagaaaggtaaaaggaaaggaccaggagagggtgttttaacgctgcgggcaaaacctccacctcctgatgaatttcttgactgtttccaaaagtttaaacacggatttaaccttctggccaaactgaagtctcatattcagaatcctagtgctgcagatttggttcactttttgtttactccattaaatatggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagagcattccagtgtatcagagtatcatccagccgatggctatgcgttcagtagcaacatttacacaagaggatcccacctggaccaaggggaagctgctgttgcttttaagccaacttctaatcgccatatagatagaaattatgaaccactcaaaacacaacccaagaaatatgccaaatccaagtatgactttgtagcaaggaacaacagtgagctctcggttctaaaggatgatattttagagatacttgatgatcggaagcaatggtggaaagttcgaaatgcaagtggagactctggatttgtgccaaataacattttggatattgtgagacctccagaatctggattggggcgtgctgatccaccttatactcatactatacagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaaacttccggtggaccgaaggaaatctcagatggaggaagtgcaagatgaactcatccacagactgaccattggtcggagtgccgctcagaagaaattccatgtgccacgg

SEQ ID NO: 9660 - DNA, 374 bp, Homo sapiens
agaaggctcagagaatggaggcagccagacacccgttttagtacagtgtggagctgaaggaagtatatattaaaaaacaaacaaacaatggactttggaatcagaccttatctgccttggttttcttatcaaagaggtggaaatgtcaaaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaa

SEQ ID NO: 9661 - DNA, 3925 bp, Homo sapiens
agacttcacaggcagcagctagcgaggcggtctcgcccggcgcgaggccggcgctgtgctcgcctcggagatcgctgctctttagctgggtgcagaaggcggctccgcggctcgcggacgactggctgggcgcgaatcagattggggggctttctcccggtcccctcccacctcgtctgggctcgcggcgtctccggggaaagccgtggccccgagggcggatccgagctccttgggttctggaaagtgagcactagtaatggacgtcatgtggtaaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaacacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatcaaagaatgaactggagaattttcctttaaacacaatccagcactgccaagctgtgatgcattcatgcagctatgattcagttcttgcactggtgtgcaaagagccaacccagaacaagccagatcttcatctcttccagtgtgatgaggttaaggcaaacctaattagtgaagatattgaaagtgcaatcagtgacagtaaaggagggaaacagaagaggcggcccgacgccctgaggatgatttccaatgcagaccctagtataccgcctccacccagagctcctgcccctgcgccccctgggaccgtcacccaggtggatgttagaagtcgagtggcagcctggtctgcatgggcagccgaccaaggggactttgagaaaccaaggcagtatcatgagcaggaagaaacacctgagatgatggcagcccgcattgacagagatgtgcaaatcttaaaccacattttggatgacattgaattttttatcacaaaactccaaaaagcagcagaagcattttctgagctttctaaaaggaagaaaaacaagaaaggtaaaaggaaaggaccaggagagggtgttttaacgctgcgggcaaaacctccacctcctgatgaatttcttgactgtttccaaaagtttaaacacggatttaaccttctggccaaactgaagtctcatattcagaatcctagtgctgcagatttggttcactttttgtttactccattaaatatggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagagcattccagtgtatcagagtatcatccagccgatggctatgcgttcagtagcaacatttacacaagaggatcccacctggaccaaggggaagctgctgttgcttttaagccaacttctaatcgccatatagatagaaattatgaaccactcaaaacacaacccaagaaatatgccaaatccaagtatgactttgtagcaaggaacaacagtgagctctcggttctaaaggatgatattttagagatacttgatgatcggaagcaatggtggaaagttcgaaatgcaagtggagactctggatttgtgccaaataacattttggatattgtgagacctccagaatctggattggggcgtgctgatccaccttatactcatactatacagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattccaacatgctttgttttaagaagccttgaagggaatgtcagattcatttttcttgatgtaatttatcaccataaaaaaaaacccatgcaaacctgagtgagcacaggatttgcttctaggcccattatttttattaaaactgaaaaaatttaaactgaattttttgaccttggaaaatatttttcttactttaccaaggtgaagtttccttaattagactaattattttatccccatcccagggtataaacaggaattgttttgatagtggtggagttattcactgcaacaaagcaacaatgttgtccatgattcaaaatctaagcagtttcgattttgcctgtgaatatggtgtctgtcattcagggcatagctcactgtaggctagcctctgcttacttaagtctcttctctgacatactcaatggaagaatatttagatttatttaaagttcttaatgccaacagtttaaaaaaaaattaaaacatttgaatgaactgtaaagtacagccataccttggacatgcaaatataaatctatggagcattctcaagagagtttgtcatggctctgttgattgcaactccttgtatagcttgtattttgatttagtttatattctgcttattatgtatactgtgttcttatatatgagaaagcacaaatgcgaaagaggtcatgtcttctcaaaatctagcaaaggaagtagtctgcattggtgtgcattacagtattttgcttaatgaaagcctcagttctgaatgttgatatgagtagttaaaaggaagtggggccattttatgtgtttatctgtgtcaagtatttctggtaataagaagcacttaatttacacatattttaatcctgtgaaagattccacatagagaaaagaaagatacctaaccttcaacaaatgttatttttggaaacacaatttttgtcattaaatgttatattatttcacatatataaaacagatgttatgtaagaatgttgtatattttaacataaatcatttagagaaattatctagattcattaattttcatagtgcctttttcacatgagtcagctggaaagtctgcaataaacagtatttgctgtctgttaataaa

SEQ ID NO: 9662 - DNA, 2965 bp, Homo sapiens
acaatgccgaaactgacgcttagagtcccaccctttctgacgttgtgccaaaggtcacttggcacataagtaaactgagtggaatggcctctcaatattgcctggacgattgcttagaggagtatttcctgaactgtgtggaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaacacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatcaaagaatgaactggagaattttcctttaaacacaatccagcactgccaagctgtgatgcattcatgcagctatgattcagttcttgcactggtgtgcaaagagccaacccagaacaagccagatcttcatctcttccagtgtgatgaggttaaggcaaacctaattagtgaagatattgaaagtgcaatcagtgacagtaaaggagggaaacagaagaggcggcccgacgccctgaggatgatttccaatgcagaccctagtataccgcctccacccagagctcctgcccctgcgccccctgggaccgtcacccaggtggatgttagaagtcgagtggcagcctggtctgcatgggcagccgaccaaggggactttgagaaaccaaggcagtatcatgagcaggaagaaacacctgagatgatggcagcccgcattgacagagatgtgcaaatcttaaaccacattttggatgacattgaattttttatcacaaaactccaaaaagcagcagaagcattttctgagctttctaaaaggaagaaaaacaagaaaggtaaaaggaaaggaccaggagagggtgttttaacgctgcgggcaaaacctccacctcctgatgaatttcttgactgtttccaaaagtttaaacacggatttaaccttctggccaaactgaagtctcatattcagaatcctagtgctgcagatttggttcactttttgtttactccattaaatatggtggtgcaggcaacaggaggtcctgaactagccagttcagtacttagtcccctattgaataaggacacaattgatttcttaaattatactgtcaatggtgatgaacggcagctgtggatgtcattgggaggaacttggatgaaagccagagcagagtggccaaaagaacagtttattccaccatatgttccacgattccgcaatggctgggagcccccaatgctgaactttatgggagccacaatggaacaagatctttatcaactggcagaatctgtggcaaatgtagcagaacatcagcgcaaacaggaaataaaaagattatccacagagcattccagtgtatcagagtatcatccagccgatggctatgcgttcagtagcaacatttacacaagaggatcccacctggaccaaggggaagctgctgttgcttttaagccaacttctaatcgccatatagatagaaattatgaaccactcaaaacacaacccaagaaatatgccaaatccaagtatgactttgtagcaaggaacaacagtgagctctcggttctaaaggatgatattttagagatacttgatgatcggaagcaatggtggaaagttcgaaatgcaagtggagactctggatttgtgccaaataacattttggatattgtgagacctccagaatctggattggggcgtgctgatccaccttatactcatactatacagaaacaaaggatggagtatggcccaagaccagctgatactccccctgctccatcacctcctccaacaccagctcctgttcctgttccccttcccccttccactccagcacctgttcctgtgtcaaaggtcccagcaaatataacacgtcaaaacagcagctccagtgacagtggtggcagtatcgtgcgagacagccagagacacaaacaacttccggtggaccgaaggaaatctcagatggaggaagtgcaagatgaactcatccacagactgaccattggtcggagtgccgctcagaagaaattccatgtgccacggcagaacgtgccagttatcaatatcacttacgactccacaccagaggatgtgaagacgtggttacagtcaaagggattcaaccctgtgactgtcaatagtcttggagtattaaatggtgcacaacttttctctctcaataaggatgaactgaggacagtctgccctgaaggggcgagagtctatagccaaatcactgtacaaaaagctgcattggaggatagcagtggcagctccgagttacaagaaattatgagaagacgacaggaaaaaatcagtgctgccgctagtgattcaggagtggaatcttttgatgaaggaagcagtcactaatttgtttgtttgtatttaaactccattgtttttggcattattccaacatgctttgttttaagaagccttgaagggaatgtcagattcatttttcttgatgtaatttatcaccataaaaaaaaacccatgcaaacctgagtgagcacaggatttgcttctaggcccattatttttattaaaactgaaaaaatttaaactgaattttttgaccttggaaaatatttttcttactttaccaaggtgaagtttccttaattagactaattattttatccccatcccagggtataaacaggaattgttttgatagtggtggagttattcactgcaacaa

SEQ ID NO: 9663 - DNA, 577 bp, Homo sapiens
acaggcagcagctagcgaggcggtctcgcccggcgcgaggccggcgctgtgctcgcctcggagatcgctgctctttagctgggtgcagaaggcggctccgcggctcgcggacgactggctgggcgcgaatcagattggggggctttctcccggtcccctcccacctcgtctgggctcgcggcgtctccggggaaagccgtggccccgagggcggatccgaggacggtcagtaaaatcttcccctgaggacattgtgattgaactgagatctgaagaatgagacagaattaactcgaagtgaccagatcttgaatattatttctttatgtaggctttctgtgctcttccaatcagaaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgtt

SEQ ID NO: 9664 - DNA, 542 bp, Homo sapiens
attgccatggtgatgaataatctgctgagttttatggttggcatgattcttctggattaggtcacttgtgttttctttctataataccagtcgactacgcttttggtaacagttaaagttccatcactaaaaagctaaacacacaagtgaaagacacaatgaatggtcatatttctaatcatcccagtagttttggaatgtacccatctcagatgaatggctacggatcatcacctaccttttcccagacggacagagaacatggttcaaaaacaagtgcaaaggccctttatgaacaaaggaagaattatgcacgggacagtgtcagcagtgtgtcagatatatctcaataccgtgttgaacacttgactacctttgtcctggatcggaaagatgctatgatcactgttgatgatggaataaggaaattgaaattgcttgatgccaagggcaaagtgtggactcaagatatgattcttcaagtggatgacagagctgtgagcctgattgatttagaatcaaagaatgaactggagaatttt

SEQ ID NO: 9665 - DNA, 3100 bp, Homo sapiens
atgcgcttccgctttggggtggtggtgccacccgccgtggccggcgcccggccggagctgctggtggtggggtcgcggcccgagctggggcgttgggagccgcgcggtgccgtccgcctgaggccggccggcaccgcggcgggcgacggggccctggccctgcaggagccgggcctgtggctcggggaggtggagctggcggccgaggaggcggcgcaggacggggcggagattggggccacccctaagttacccagcaccatctttccttggtttgttttgagacagggtctcattctaggcaatggacctcatcatgaccgttgctgtacttacaatgaaaacaacttggtggatggtgtgtattgtctcccaataggacactggattgaggccactgggcacaccaatgaaatgaagcacacaacagacttctattttaatattgcaggccaccaagccatgcattattcaagaattctaccaaatatctggctgggtagctgccctcgtcaggtggaacatgtaaccatcaaactgaagcatgaattggggattacagctgtaatgaatttccagactgaatgggatattgtacagaattcctcaggctgtaaccgctacccagagcccatgactccagacactatgattaaactatatagggaagaaggcttggcctacatctggatgccaacaccagatatgagcaccgaaggccgagtacagatgctgccccaggcggtgtgcctgctgcatgcgctgctggagaagggacacatcgtgtacgtgcactgcaacgctggggtgggccgctccaccgcggctgtctgcggctggctccagtatgtgatgggctggaatctgaggaaggtgcagtatttcctcatggccaagaggccggctgtctacattgacgaagaggccttggcccgggcacaagaagattttttccagaaatttgggaaggttcgttcttctgtgtgtagcctgtagctggtcagcctgcttctgccccctcctgatttccctaaggagcctgggatgatgttggtcaaatgacctagaaacaaggattctacctgaactgaaaggactgtgtgacctcccccaagccaaccactttcacctgggatgactttcgattatgctttgttttggggctgtatttttgaaatactctacaagaaagctgtggctcaacacatgagaagaagcacgaagcagttaggctgtacatcagacagaagggtaatgcgtgcagttcctgctgcctgcaggcagacgaggcctttgctttacagcactgtatgtgttgcacgatggatccgtgacagcactttcctgttgcactgaaactcttggccatgtagaggaaaagatatggagttatgtggatttcatcactagtatgtgtgcgtgagctggtcagttgccaaaggaggaaataaggttagaagcctgaaccgttacaaaagaagagctcactatggtcaaaaagtgatggctttcaggacttgttttttatcctgcctcacagttgttaaagtctgttccaaggcatcaccttccttctctacccaacaaccctgtgtaacaactaaagtagaattatctctcatttgttgttgtttttcctcaaaattaccaaacaaagcaaaaaatacccttgttttttatagttgagatgtcaagaagttaaattgaggcttaatgagcataggtagcttgtccaaggtctcatgaccagtcaagggcaagctggagttaataatctatatttatttgactcagcactgttttcatcacaacttgttttcccagcatcatgtagtgcatttagttttgtctttctcagggtatagtcaatatgcctgcaggagtttctatagcgagacatagaatagtattctgatcagttgccaaagaatctaggaaattagttgtattttgtgcaagctaatttaaaaacatgatgggctgttttaagaccagagtggaaattcatgagaggaactatactaccaaaagagcccaaatgaccaaatccatggataattgcttcacagccttggccatcctggctcagctctcaatttagtataatatgcagttcctgtgcctccagactatgcagctcatcaccctaggttctacaggaaatacagagatgaacaactttgccttcaaaaatgtgctgcctagaaacagacctgcattcaaccaactgtaatgcaggattggaccatgaatgatatgctagaatagaagaaagagaagtgtttttttaattgagagcctctatgtgcaaggtgatatataatcatatccagtttaatcttcacaatatccaatgaagaaggtctcattatctccatgataaagatggggaaactaaggtcagaagggttaactcaactgtctattgtcacatgatgaataaatagatgaagtgagatacaaagctgggtttgattcaaagcccttactttcctaattaaactatgatgcgtatttatttttctgcaccttcctttcttccacaaacacatattgatagatgcaagagactcttatttagaaggcgtgggggacaagaaggatacaaggtaagtttcagtggagctcagaggacggggagatagaactgtggcacttaggggagatgacatttgctttgggcagaggcagctagccaggacacatttccactataattttacaaagttaaatttataagctagcattaagtaaagtgaagtccagctcccttgctaaaaataactagaggtaataattggtattcaggtaactcatttacagtcataatgtgttgtgaaaatttaatcttaaaaattaaatttttaaactatgtgggtctgtgaatttctttaatgtctaagaaatccagcttcataatttccatgatacaaagatcttttttcaggtggatttttacctttgttccttttgctctgatagacaaaatcagtttaggactattaaagaatgttttggaataaactgtctttttcctcaatgaatgggatgtctaatgtatttcaaaatcacccaaaacttttggcaaataaaagcattt

SEQ ID NO: 9666 - DNA, 3633 bp, Homo sapiens
tacagacaaagaacctgagacctgctagagtaagtgacttggttaagatagggagcgctccagagaccaggtccaagatcttcccccgtttcacaattagaaggcggctgtctagaggtcattcccttccttatgatcctcataaagttaatttccagtctcttggagagagaactggacgatcgcctggcttagaagttttcctccctccccgaaccccgttttctcttccatttcttccggtcgcgtgtccccagcgcccacaggtggaaatcaaccgcccgcggggttgcggggcacaaagaggcagctagcggctccgctgaccccttcccgccggcctggacgaagtctgggctcgggagccgcgtgatgcatcccaaagaaggcgcagaacagcacgtgttctccccggtgcccggggctcccacaccaccgcccaatcgctgcggccgcctagtgctcgggccgcgcctgccggccgcggggactccgggcccgggtattcgcgccgccgccgcccgccatgcgcttccgctttggggtggtggtgccacccgccgtggccggcgcccggccggagctgctggtggtggggtcgcggcccgagctggggcgttgggagccgcgcggtgccgtccgcctgaggccggccggcaccgcggcgggcgacggggccctggccctgcaggagccgggcctgtggctcggggaggtggagctggcggccgaggaggcggcgcaggacggggcggagccgggccgcgtggacacgttctggtacaagttcctgaagcgggagccgggaggagagctctcctgggaaggcaatggacctcatcatgaccgttgctgtacttacaatgaaaacaacttggtggatggtgtgtattgtctcccaataggacactggattgaggccactgggcacaccaatgaaatgaagcacacaacagacttctattttaatattgcaggccaccaagccatgcattattcaagaattctaccaaatatctggctgggtagctgccctcgtcaggtggaacatgtaaccatcaaactgaagcatgaattggggattacagctgtaatgaatttccagactgaatgggatattgtacagaattcctcaggctgtaaccgctacccagagcccatgactccagacactatgattaaactatatagggaagaaggcttggcctacatctggatgccaacaccagatatgagcaccgaaggccgagtacagatgctgccccaggcggtgtgcctgctgcatgcgctgctggagaagggacacatcgtgtacgtgcactgcaacgctggggtgggccgctccaccgcggctgtctgcggctggctccagtatgtgatgggctggaatctgaggaaggtgcagtatttcctcatggccaagaggccggctgtctacattgacgaagaggccttggcccgggcacaagaagattttttccagaaatttgggaaggttcgttcttctgtgtgtagcctgtagctggtcagcctgcttctgccccctcctgatttccctaaggagcctgggatgatgttggtcaaatgacctagaaacaaggattctacctgaactgaaaggactgtgtgacctcccccaagccaaccactttcacctgggatgactttcgattatgctttgttttggggctgtatttttgaaatactctacaagaaagctgtggctcaacacatgagaagaagcacgaagcagttaggctgtacatcagacagaagggtaatgcgtgcagttcctgctgcctgcaggcagacgaggcctttgctttacagcactgtatgtgttgcacgatggatccgtgacagcactttcctgttgcactgaaactcttggccatgtagaggaaaagatatggagttatgtggatttcatcactagtatgtgtgcgtgagctggtcagttgccaaaggaggaaataaggttagaagcctgaaccgttacaaaagaagagctcactatggtcaaaaagtgatggctttcaggacttgttttttatcctgcctcacagttgttaaagtctgttccaaggcatcaccttccttctctacccaacaaccctgtgtaacaactaaagtagaattatctctcatttgttgttgtttttcctcaaaattaccaaacaaagcaaaaaatacccttgttttttatagttgagatgtcaagaagttaaattgaggcttaatgagcataggtagcttgtccaaggtctcatgaccagtcaagggcaagctggagttaataatctatatttatttgactcagcactgttttcatcacaacttgttttcccagcatcatgtagtgcatttagttttgtctttctcagggtatagtcaatatgcctgcaggagtttctatagcgagacatagaatagtattctgatcagttgccaaagaatctaggaaattagttgtattttgtgcaagctaatttaaaaacatgatgggctgttttaagaccagagtggaaattcatgagaggaactatactaccaaaagagcccaaatgaccaaatccatggataattgcttcacagccttggccatcctggctcagctctcaatttagtataatatgcagttcctgtgcctccagactatgcagctcatcaccctaggttctacaggaaatacagagatgaacaactttgccttcaaaaatgtgctgcctagaaacagacctgcattcaaccaactgtaatgcaggattggaccatgaatgatatgctagaatagaagaaagagaagtgtttttttaattgagagcctctatgtgcaaggtgatatataatcatatccagtttaatcttcacaatatccaatgaagaaggtctcattatctccatgataaagatggggaaactaaggtcagaagggttaactcaactgtctattgtcacatgatgaataaatagatgaagtgagatacaaagctgggtttgattcaaagcccttactttcctaattaaactatgatgcgtatttatttttctgcaccttcctttcttccacaaacacatattgatagatgcaagagactcttatttagaaggcgtgggggacaagaaggatacaaggtaagtttcagtggagctcagaggacggggagatagaactgtggcacttaggggagatgacatttgctttgggcagaggcagctagccaggacacatttccactataattttacaaagttaaatttataagctagcattaagtaaagtgaagtccagctcccttgctaaaaataactagaggtaataattggtattcaggtaactcatttacagtcataatgtgttgtgaaaatttaatcttaaaaattaaatttttaaactatgtgggtctgtgaatttctttaatgtctaagaaatccagcttcataatttccatgatacaaagatcttttttcaggtggatttttacctttgttccttttgctctgatagacaaaatcagtttaggactattaaagaatgttttggaataaactgtctttttcctcaatgaatgggatgtctaatgtatttcaaaatcacccaaaacttttggcaaataaaagcatttaaaaaga

SEQ ID NO: 9667 - DNA, 1694 bp, Homo sapiens
gagaactggacgatcgcctggcttagaagttttcctccctccccgaaccccgttttctcttccatttcttccggtcgcgtgtccccagcgcccacaggtggaaatcaaccgcccgcggggttgcggggcacaaagaggcagctagcggctccgctgaccccttcccgccggcctggacgaagtctgggctcgggagccgcgtgatgcatcccaaagaaggcgcagaacagcacgtgttctccccggtgcccggggctcccacaccaccgcccaatcgctgcggccgcctagtgctcgggccgcgcctgccggccgcggggactccgggcccgggtattcgcgccgccgccgcccgccatgcgcttccgctttggggtggtggtgccacccgccgtggccggcgcccggccggagctgctggtggtggggtcgcggcccgagctggggcgttgggagccgcgcggtgccgtccgcctgaggccggccggcaccgcggcgggcgacggggccctggccctgcaggagccgggcctgtggctcggggaggtggagctggcggccgaggaggcggcgcaggacggggcggagccgggccgcgtggacacgttctggtacaagttcctgaagcgggagccgggaggagagctctcctgggaaggcaatggacctcatcatgaccgttgctgtacttacaatgaaaacaacttggtggatggtgtgtattgtctcccaataggacactggattgaggccactgggcacaccaatgaaatgaagcacacaacagacttctattttaatattgcaggccaccaagccatgcattattcaagaattctaccaaatatctggctgggtagctgccctcgtcaggtggaacatgtaaccatcaaactgaagcatgaattggggattacagctgtaatgaatttccagactgaatgggatattgtacagaattcctcaggctgtaaccgctacccagagcccatgactccagacactatgattaaactatatagggaagaaggcttggcctacatctggatgccaacaccagatatgagcaccgaaggccgagtacagatgctgccccaggcggtgtgcctgctgcatgcgctgctggagaagggacacatcgtgtacgtgcactgcaacgctggggtgggccgctccaccgcggctgtctgcggctggctccagtatgtgatgggctggaatctgaggaaggtgcagtatttcctcatggccaagaggccggctgtctacattgacgaagaggcagctagccaggacacatttccactataattttacaaagttaaatttataagctagcattaagtaaagtgaagtccagctcccttgctaaaaataactagaggtaataattggtattcaggtaactcatttacagtcataatgtgttgtgaaaatttaatcttaaaaattaaatttttaaactatgtgggtctgtgaatttctttaatgtctaagaaatccagcttcataatttccatgatacaaagatcttttttcaggtggatttttacctttgttccttttgctctgatagacaaaatcagtttaggactattaaagaatgttttggaataaactgtctttttcctcaatgaatgggatgtctaatgtatttcaaaatcacccaaaacttttggcaaataaaagcattt

SEQ ID NO: 9668 - DNA, 1037 bp, Homo sapiens
tggacacgttctggtacaagttcctgaagcgggagccgggaggagagctctcctgggaaggcaatggacctcatcatgaccgttgctgtacttacaatgaaaacaacttggtggatggtgtgtattgtctcccaataggacactggattgaggccactgggcacaccaatgaaatgaagcacacaacagacttctattttaatattgcaggccaccaagccatgcattattcaagaattctaccaaatatctggctgggtagctgccctcgtcaggtggaacatgtaaccatcaaactgaagcatgaattggggattacagctgtaatgaatttccagactgaatgggatattgtacagaattcctcaggctgtaaccgctacccagagcccatgactccagacactatgattaaactatatagggaagaaggcttggcctacatctggatgccaacaccagatatgagcaccgaaggccgagtacagatgctgccccaggcggtgtgcctgctgcatgcgctgctggagaagggacacatcgtgtacgtgcactgcaacgctggggtgggccgctccaccgcggctgtctgcggctggctccagtatgtgatgggctggaatctgaggaaggtgcagtatttcctcatggccaagaggccggctgtctacattgacgaagaggcagctagccaggacacatttccactataattttacaaagttaaatttataagctagcattaagtaaagtgaagtccagctcccttgctaaaaataactagaggtaataattggtattcaggtaactcatttacagtcataatgtgttgtgaaaatttaatcttaaaaattaaatttttaaactatgtgggtctgtgaatttctttaatgtctaagaaatccagcttcataatttccatgatacaaagatcttttttcaggtggatttttacctttgttccttttgctctgatagacaaaatcagtttaggactattaaagaatgttttggaataaactgtctttttcctcaat

SEQ ID NO: 9669 - DNA, 736 bp, Homo sapiens
gcaatggacctcatcatgaccgttgctgtacttacaatgaaaacaacttggtggatggtgtgtattgtctcccaataggacactggattgaggccactgggcacaccaatgaaatgaagcacacaacagacttctattttaatattgcaggccaccaagccatgcattattcaagaattctaccaaatatctggctgggtagctgccctcgtcaggtggaacatgtaaccatcaaactgaagcatgaattggggattacagctgtaatgaatttccagactgaatgggatattgtacagaattcctcaggctgtaaccgctacccagagcccatgactccagacactatgattaaactatatagggaagaaggcttggcctacatctggatgccaacaccagatatgagcaccgaagatgagaagaggacagctgacatgtgctgctcggggatgtgggaagagactgcagattttggccttgggattctggattacttaaaacaaaagtaagacacaaatatctccctaaccttattatatctcgtagaagatggcagatgggtgacgactggtgcaagctcacacaggaaagaaaaatttcataagcattgaatagttgtgttactaattagtgggacaatcttcgtaactccttcttcccccacttctgcccaatatgtaataataggcatgctctgaataattgtactcaaataagaaattactcctccaaa

SEQ ID NO: 9670 - DNA, 1170 bp, Homo sapiens
gagaactggacgatcgcctggcttagaagttttcctccctccccgaaccccgttttctcttccatttcttccggtcgcgtgtccccagcgcccacaggtggaaatcaaccgcccgcggggttgcggggcacaaagaggcagctagcggctccgctgaccccttcccgccggcctggacgaagtctgggctcgggagccgcgtgatgcatcccaaagaaggcgcagaacagcacgtgttctccccggtgcccggggctcccacaccaccgcccaatcgctgcggccgcctagtgctcgggccgcgcctgccggccgcggggactccgggcccgggtattcgcgccgccgccgcccgccatgcgcttccgctttggggtggtggtgccacccgccgtggccggcgcccggccggagctgctggtggtggggtcgcggcccgagctggggcgttgggagccgcgcggtgccgtccgcctgaggccggccggcaccgcggcgggcgacggggccctggccctgcaggagccgggcctgtggctcggggaggtggagctggcggccgaggaggcggcgcaggacggggcggagccgggccgcgtggacacgttctggtacaagttcctgaagcgggagccgggaggagagctctcctgggaaggcaatggacctcatcatgaccgttgctgtacttacaatgaaaacaacttggtggatggtgtgtattgtctcccaataggacactggattgaggccactgggcacaccaatgaaatgaagcacacaacagacttctattttaatattgcaggccaccaagccatgcattattcaagaattctaccaaatatctggctgggtagctgccctcgtcaggtggaacatgtaaccatcaaactgaagcatgaattggggattacagctgtaatgaatttccagactgaatgggatattgtacagaattcctcaggctgtaaccgctacccagagcccatgactccagacactatgattaaactatatagggaagaaggcttggcctacatctggatgccaacaccagatatgagcaccgaagatgagaagaggacagctgacatgtgctgctcggggatgtgggaagagactgcagattttggccttgggattctggattacttaaaacaaaagtaa

SEQ ID NO: 9671 - DNA, 1724 bp, Homo sapiens
aactgcagcgccggggctgggggaggggagcctactcactcccccaactcccgggcggtgactcatcaacgagcaccagcggccagaggtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaatttcttaactttga

SEQ ID NO: 9672 - DNA, 2756 bp, Homo sapiens
accgcccattacacaccccagtacaccagcagaggaaacttataacctcgggaggcaggtccttcccctcagtgcggtcacatacttccagaagagcggaccagggctgctgccagcacctgccactcagagcgcctctgtcgctgggacccttcagaactctctttgctcacaagttaccaaaaaaaaaagagccaacatgttggtattgctggctggtatctttgtggtccacatcgctactgttattatgctatttgttagcaccattgccaatgtctggttggtttccaatacggtagatgcatcagtaggtctttggaaaaactgtaccaacattagctgcagtgacagcctgtcatatgccagtgaagatgccctcaagacagtgcaggccttcatgattctctctatcatcttctgtgtcattgccctcctggtcttcgtgttccagctcttcaccatggagaagggaaaccggttcttcctctcaggggccaccacactggtgtgctggctgtgcattcttgtgggggtgtccatctacactagtcattatgcgaatcgtgatggaacgcagtatcaccacggctattcctacatcctgggctggatctgcttctgcttcagcttcatcatcggcgttctctatctggtcctgagaaagaaataaggccggacgagttcatggggatctggggggtggggaggaggaagccgttgaatctgggagggaagtggaggttgctgtacaggaaaaaccgagataggggaggggggagggggaagcaaaggggggaggtcaaatcccaaaccattactgaggggattctctactgccaagcccctgccctggggagaaagtagttggctagtactttgatgctcccttgatggggtccagagagcctccctgcagccaccagacttggcctccagctgttcttagtgacacacactgtctggggccccatcagctgccacaacaccagccccacttctgggtcatgcactgaggtccacagacctactgcactgagttaaaatagcggtacaagttctggcaagagcagatactgtctttgtgctgaatacgctaagcctggaagccatcctgcccttctgacccaaagcaaaacatcacattccagtctgaagtgcctactggggggctttggcctgtgagccattgtccctctttggaacagatatttagctctgtggaattcagtgacaaaatgggaggaggaaagagagtttgtaaggtcatgctggtgggttagctaaaccaagaaggagaccttttcacaatggaaaacctgggggatggtcagagcccagtcgagacctcacacacggctgtccctcatggagacctcatgccatggtctttgctaggcctcttgctgaaagccaaggcagctcttctggagtttctctaaagtcactagtgaacaattcggtggtaaaagtaccacacaaactatgggatccaaggggcagtcttgcaacagtgccatgttagggttatgtttttaggattcccctcaatgcagtcagtgtttcttttaagtatacaacaggagagagatggacatggctcattgtagcacaatcctattactcttcctctaacatttttgaggaagttttgtctaattatcaatattgaggatcagggctcctaggctcagtggtagctctggcttagacaccacctggagtgatcacctcttggggaccctgcctatcccacttcacaggtgaggcatggcaattctggaagctgattaaaacacacataaaccaaaaccaaacaacaggcccttgggtgaaaggtgctatataattgtgaagtattaagcctaccgtatttcagccatgataagaacagagtgcctgcattcccaggaaaatacgaaaatcccatgagataaataaaaatataggtgatgggcagatcttttctttaaaataaaaaagcaaaaactcttgtggtacctagtcagatggtagacgagctgtctgctgccgcaggagcacctctatacaggacttagaagtagtatgttattcctggttaagcaggcattgctttgccctggagcagctattttaagccatctcagattctgtctaaaggggttttttgggaagacgttttctttatcgccctgagaagatctaccccagggagaatctgagacatcttgcctacttttctttattagctttctcctcatccatttcttttatacctttcctttttggggagttgttatgccatgatttttggtatttatgtaaaaggattattactaattctatttctctatgtttattctagttaaggaaatgttgagggcaagccaccaaattacctaggctgaggttagagagattggccagcaaaaactgtgggaagatgaactttgtcattatgatttcattatcacatgattatagaaggctgtcttagtgcaaaaaacatacttacatttcagacatatccaaagggaatactcacattttgttaagaagttgaactatgactggagtaaaccatgtattcccttatcttttactttttttctgtgacatttatgtctcatgtaatttgcattactctggtggattgttctagtactgtattgggcttcttcgttaatagattatttcatatactataattgtaaatattttgatacaaatgtttataactctagggatataaaaacagattctgattcccttca

SEQ ID NO: 9673 - DNA, 675 bp, Homo sapiens
agtgcggtcacatacttccagaagagcggaccagggctgctgccagcacctgccactcagagcgcctctgtcgctgggacccttcagaactctctttgctcacaagttaccaaaaaaaaaagagccaacatgttggtattgctggctggtatctttgtggtccacatcgctactgttattatgctatttgttagcaccattgccaatgtctggttggtttccaatacggtagatgcatcagtaggtctttggaaaaactgtaccaacattagctgcagtgacagcctgtcatatgccagtgaagatgccctcaagacagtgcaggccttcatgattctctctatcatcttctgtgtcattgccctcctggtcttcgtgttccagctcttcaccatggagaagggaaaccggttcttcctctcaggggccaccacactggtgtgcttcattatgcgaatcgtgatggaacgcagtatcaccacggctattcctacatcctgggctggatctgcttctgcttcagcttcatcatcggcgttctctatctggtcctgagaaagaaataaggccggacgagttcatggggatctggggggtggggaggaggaagccgttgaatctgggagggaagtggaggttgctgtacaggaaaaaccgagataggggaggggggag

SEQ ID NO: 9674 - DNA, 555 bp, Homo sapiens
acacaccccagtacaccagcagaggaaacttataacctcgggaggcaggtccttcccctcagtgcggtcacatacttccagaagagcggaccagggctgctgccagcacctgccactcagagcgcctctgtcgctgggacccttcaggactgctgggcagaccgctggggaaaggaaagagatcccttctgtggagagtggaaaggactcactgtgccttcctcagcccttcctgcttcctccagagaccagattaggcccatcaagttcccagccttgtcagtgggcttcatggagacccctcacccgggaatgtagaccctcttggcttgctctgggtggctctagggatttcaggtagtgccagacccacagggactactggagagagacacgttgaagaccggggaaaacttgtggatgaggcaagactgcttttctgtagactctatggagcctggtggggcacataactgaaacgtggacacaggaaagggcaggagaactctctttgctcacaagttaccaaaaaaaaaagagccaacatgttggtat

SEQ ID NO: 9675 - DNA, 5197 bp, Homo sapiens
ggcgggatcggggaaggaggggccccgccgcctagagggtggagggagggcgcgcagtcccagcccagagcttcaaaacagcccggcggcctcgcctcgcacccccagccagtccgtcgatccagctgccagcgcagccgccagcgccggcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaaaaaaaaaaaaagaaaaaagaaaaaaaaaatccaaaagagagaagagtttttgcattcttgagatcagagaatagactatgaaggctggtattcagaactgctgcccactcaaaagtctcaacaagacacaagcaaaaatccagcaatgctcaaatccaaaagcactcggcaggacatttcttaaccatggggctgtgatgggaggagaggagaggctgggaaagccgggtctctggggacgtgcttcctatgggtttcagctggcccaagcccctcccgaatctctctgctagtggtgggtggaagagggtgaggtggggtataggagaagaatgacagcttcctgagaggtttcacccaagttccaagtgagaagcaggtgtagtccctggcattctgtctgtatccaaaccagagcccagccatccctccggtatcggggtgggtcagaaaaagtctcacctcaatttgccgacagtgtcacctgcttgccttaggaatggtcatccttaacctgcgtgccagatttagactcgtctttaggcaaaacctacagcgccccccccctcaccccagacctacagaatcagagtcttcaagggatggggccagggaatctgcatttctaacgcgctccctgggcaacgcttcagatgcgttgaagttggggaccacggtgcctgggccaggtcagcagagctgcctcgtaaatgctggggtatcgtcatgtggagatggggaggtgaatgcaacccccacagcaggccaaaaccttggcctccatcgccacagctgtctacatctagggccccaaaactccattcctgagccatgtgaactcatagacaccttcagggtgtggggtacagcctccttcccatcttatcccagaaggcctctcccttcttgtccagcccttcatgctacacctggctggcctctcacccctatttctagagcctcagaggacccatccaccattcattcattcattcattcattcattcattcattcattcatcaacataaatcataacttgcatgcatgtgccaggcacaggggataccctctagagacaatctcctcctagggctcatggcctagtggaggagacagattaaaacttaattagaaaaactggctgggtacagtggctcatgcttgtaatcccagcactttgggaggctgaggcgggtggatcacctgaggtcaggagttcaagaccagcctggccaaaatggtaaaacctgtctctactaaaaatacaaaaatgagctgggcgtggtggtgcatgcctgtaatcccagctatcaggtggctgaggcaggagaatcacttgaaatgggaggtggaggttgcagtgagccgagaccgtgccactgcactccagcctgggtgacagagtgagactccatctcaaaaaaagaaaaaaaagaaaagaaactaattacacactgtgatggaggctgcaaagaacaccactaagaattcaaaatcagctgggtgcggtggctcacacctgtaatcccagcactttgggaggctgaggcaggtggatcacaaggtcaggagttcaagaccagcctggccaacatggtgaaaccccgtctctaccgaaaatacaacaaaattagcccggtgtggtggcaggtgcctgtaatcccagctacttaggaggctgaggcaggagaatcgcttgaaactgggaggcggaggtcgcagtgagccgagattcaccactgcactccagcccaggcgacagtctgagactccgtctcaaaaataaaacgattcaaaatcgaggcctgtggcatggtagggaggctgctttacgcgtgcctattattaaatgctcctggaggcatttaggtatttagatcagtctaaatatagctccattcagttcgtgcagatgacagttattgggcagtacctgtctgtgtaacacccagaaaacatgtctgtggaggggcccatggtcccgacagtaaatgcggtgagagggtcccatagagctggagttttcaagctttaggggttcccgtgctgcttgggacaggctgattcagagggtctgggtgaatgatttccaggtgattttaagactgtgctgagaaatagggcttttggggccttgtccttcaggatcaaagcatgatgctgtgtggcaatgcagaccacccaggaaccatcccaggagataagctctttgcacctcattgtctttttctgcttatgttggagcaggatgctgggggctgtcctgggatggggtgtgggacctcgtgctatttaaatacttttgcacttgaccttctgctgagtggagtggtggtttgccatcagctcagttccagtggagctgaagagacatctggtttgagtagttttagggccaccatggatatctcttcaatgcaggattggctctttccatctgctctttcattcatttgtttttgacagatagtattaaatgtttaccatgttccaggcactgtgtgaggctctgaaaatacaggggtgagcaaatccagatatcctccctgccatcatgaagtttggagtctatgagataggaccccctccctatggagaagccaccaatgcagtacagggtgacctggggccagagacaggacaaatgtcacctcctgcctccatgagatactctcactagtcatattgtgggcaagaatgtggcttacacccctagggttaacaggatgctacccaagctcatggaggaagttgaatcttaagttcccttgaaactttctaccttggtggcttttctataattttcttttttctttttcttttttttttttttttttgagactgagttttgctcttgttgcccaggctggagtgcagtggcaccatcttggctcaccgcaacctctgcctcctgggttcaagtgattctcctgcctcagcctcccgagtagctgggattacaggcatgtcccaccatgcccagctaatttttgtatttttagtagagatggggtttctccatgttggtcaggctggtttcgaactcccaacctcaggtgatccgcccacctcagccttccaaagtgctgggattacaggcatgagccactgcgtctggccttctataattttctggtagtcacgatggaaacaaacaaaacaccttagaaccagagatcgaccccctcaagcaatacatcaattcccttcacaagaaacgtcggggctacatgagtatctgtgttgaatgcggtctgaaatgatcctatggattttcccggctggttgccactgctgtacaacattcagtgcccacatccacctgtgccattaagcttttttgagacatgagagatgcctcttccctgctgtatgacatgcatttgggaagttggaaagaaatgacaaaatcagggagaaaacatccaagcttcttacctgtagatagaatcagccctcacttggtgcttattaccagttattcaagaacaataacaacaacaaaattagtagacatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattattttgggtctctgttcaaatgagtttggagaatgcttgacttgttggtctgtgtgaatgtgtatatatatatacctgaatacaggaacatcggagacctattcactcccacacactctgctatagtttgcgtgcttttgtggacacccctcatgaacaggctggcgctctaggacgctctgtgttcactgatgatgaagaaacctagaactccaagcctgtttgtaaacacactaaacacagtggcctagatagaaactgtatcgtagtttaaaatctgcctcgcgggatgttactaaactcgctaatagtttaaaggttacttacaatagagcaagttggacaattttgtggtgttggggaaatgttagggcaaggcctagaggttcattttgaatcttggtttgtgactttagggtagttagaaactttctacttaatgtacctttaaaatagtccattttctatgttttgtataatctgaaactgtacatggaaaataaagtttaaaaccagattgcccagagcaagactctaatgttcccaacggtgatgacatctagggcagaatgctgccattttgaggggcagggggtcagctgatttctcatcaagataataatgtatggtttttacactaagcaactgataaatggacaatttatcactgga

SEQ ID NO: 9676 - DNA, 781 bp, Homo sapiens
ggcctgggagtccttgcagggtggcctgggtgactgctcaccagcccggccctccccagggttctgggccagagcctccctggccgttggagcgggagctgtgggtggaacacttctgaattgggagattgcctcggacctccagacgccgaacatctcagcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccat

SEQ ID NO: 9677 - DNA, 829 bp, Homo sapiens
cgggagcaagagagaaggaggcccagacagtgagggcaggagggagagaagagacgcagaaggagagcgagcgagagagaaagggttctggattggaggggagagcaagggagggaggaaggcggtgagagaggcgggggcctcgggagggtgaaaggagggaggagaagggcggggcacggaggcccgagcgagggacaagactccgactccagctctgacttttttcgcggctctcggcttccactgcagccatgtcactcctcttgctggtggtctcagcccttcacatcctcattcttatactgcttttcgtggccactttggacaagtcctggtggactctccctgggaaagagtccctgaatctctggtacgactgcacgtggaacaacgacaccaaaacatgggcctgcagtaatgtcagcgagaatggctggctgaaggcggtgcaggtcctcatggtgctctccctcattctctgctgtctctccttcatcctgttcatgttccagctctacaccatgcgacgaggaggtctcttctatgccaccggcctctgccagctttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcgtcctccaaaaaataaaaccttaaccgcgg

SEQ ID NO: 9678 - DNA, 3756 bp, Homo sapiens
cttttgcactagcagtagcaaggaaggggggtgggcgctctttctttttctcttagaagagggtttagcacaggttttttcgttctcacttccacaccaccttaccgcctcccgaccccccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgtccgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaattacacagcgtactatcccagccccccaggttcgcctaatagtcttggctacttccctacagctgctaatcttagcggtgtccctccacagcctggcacggtggtcagaatgcagggcctggcctacaatactggagttaaggaaattcttaacttcttccaaggttaccagtatgcaaccgaggatggacttatacacacaaatgaccaggccaggactctacccaaagaatgggtttgtatttaagggccccagcagttagaacatcctcagaaaagaagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagataaattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggatatttctctaagttactcatattgtcctttgcttgaatgcaatgccgtgcagatttatgaggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttgtagagttaacatttgataataaaacttgcctgtttaatctcaa

SEQ ID NO: 9679 - DNA, 3746 bp, Homo sapiens
atacaaaaagggcaggcctcctgcgccctccttcccaccccccttcctgccctgggcgtggagcaccgaccaggtgtgggcttgggtggttggttaccgccttttgcactagcagtagcaaggaaggggggtgggcgctctttctttttctcttagaagagggtttagcacaggttttttcgttctcacttccacaccaccttaccgcctcccgaccccccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgtccgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaattacacagcgtactatcccagccccccaggttcgcctaatagtcttggctacttccctacagctgctaatcttagcggtgtccctccacagcctggcacggtggtcagaatgcagggcctggcctacaatactggagttaaggaaattcttaacttcttccaaggttaccagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagataaattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggatatttctctaagttactcatattgtcctttgcttgaatgcaatgccgtgcagatttatgaggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttgtagagttaacatttgataataaaacttgcctgtttaatctcaa

SEQ ID NO: 9680 - DNA, 3770 bp, Homo sapiens
gcgtggagcaccgaccaggtgtgggcttgggtggttggttaccgccttttgcactagcagtagcaaggaaggggggtgggcgctctttctttttctcttagaagagggtttagcacaggttttttcgttctcacttccacaccaccttaccgcctcccgaccccccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgtccgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaattacacagcgtactatcccagccccccaggttcgcctaatagtcttggctacttccctacagctgctaatcttagcggtgtccctccacagcctggcacggtggtcagaatgcagggcctggcctacaatactggagttaaggaaattcttaacttcttccaaggttaccagtatgcaaccgaggatggacttatacacacaaatgaccaggccaggactctacccaaagaatgggtttgtatttaagggccccagcagttagaacatcctcagaaaagaagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagataaattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggatatttctctaagttactcatattgtcctttgcttgaatgcaatgccgtgcagatttatgaggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttg

SEQ ID NO: 9681 - DNA, 3482 bp, Homo sapiens
ggggggtgggcgctctttctttttctcttagaagagggtttagcacaggttttttcgttctcacttccacaccaccttaccgcctcccgaccccccctctccccctccccacctatcgtcatgacggcctctccggattacttggtggtgctttttgggatcactgctggggccaccggggccaagctaggctcggatgagaaggagttgatcctgctgttctggaaagtcgtggatctggccaacaagaaggtgggacagttgcacgaagtgctagttagaccggatcagttggaactgacggaggactgcaaagaagaaactaaaatagacgtcgaaagcctgtcctcggcgtcgcagctggaccaagccctccgacagtttaaccagtcagtgagcaatgaactgaatattggagtagggacttccttctgtctctgtactgatgggcagcttcatgtcaggcaaatcctgcatcctgaggcttccaagaagaatgtactattacctgaatgcttctattccttttttgatcttcgaaaagaattcaagaaatgttgccctggttcacctgatattgacaaactggacgttgccacaatgacagagtatttaaattttgagaagagtagttcagtctctcgatatggagcctctcaagttgaagatatggggaatataattttagcaatgatttcagagccttataatcacaggttttcagatccagagagagtgaattacaagtttgaaagtggaacttgcagcaagatggaacttattgatgataacaccgtagtcagggcacgaggtttaccatggcagtcttcagatcaagatattgcaagattcttcaaaggactcaatattgccaagggaggtgcagcactttgtctgaatgctcagggtcgaaggaacggagaagctctggttaggtttgtaagtgaggagcaccgagacctagcactacagaggcacaaacatcacatggggacccggtatattgaggtttacaaagcaacaggtgaagatttccttaaaattgctggtggtacttccaatgaggtagcccagtttctctccaaggaaaatcaagtcattgtccgcatgcgggggctccctttcacggccacagctgaagaagtggtggccttctttggacagcattgccctattactgggggaaaggaaggcatcctctttgtcacctacccagatggtaggccaacaggggacgcttttgtcctctttgcctgtgaggaatatgcacagaatgcgttgaggaagcataaagacttgttgggtaaaagatacattgaactcttcaggagcacagcagctgaagttcagcaggtgctgaatcgattctcctcggcccctctcattccacttccaacccctcccattattccagtactacctcagcaatttgtgccccctacaaatgttagagactgtatacgccttcgaggtcttccctatgcagccacaattgaggacatcctggatttcctgggggagttcgccacagatattcgtactcatggggttcacatggttttgaatcaccagggccgcccatcaggagatgcctttatccagatgaagtctgcggacagagcatttatggctgcacagaagtgtcataaaaaaaacatgaaggacagatatgttgaagtctttcagtgttcagctgaggagatgaactttgtgttaatggggggcactttaaatcgaaatggcttatccccaccgccatgtaagttaccatgcctgtctcctccctcctacacatttccagctcctgctgcagttattcctacagaagctgccatttaccagccctctgtgattttgaatccacgagcactgcagccctccacagcgtactacccagcaggcactcagctcttcatgaattacacagcgtactatcccagtgtttgaaagatgtatggtgatcttgaaacctccagacacaagaaaacttctagcaaattcaggggaagtttgtctacactcaggctgcagtattttcagcaaacttgattggacaaacgggcctgtgccttatcttttggtggagtgaaaaaatttgagctagtgaagccaaatcgtaacttacagcaagcagcatgcagcatacctggctctttgctgattgcaaataggcatttaaaatgtgaatttggaatcagatgtctccattacttccagttaaagtggcatcataggtgtttcctaagttttaagtcttggataaaaactccaccagtgtctaccatctccaccatgaactctgttaaggaagcttcatttttgtatattcccgctcttttctcttcatttccctgtcttctgcataatcatgccttcttgctaagtaattcaagcataagatcttggaataataaaatcacaatcttaggagaaagaataaaattgttattttcccagtctcttggccatgatgatatcttatgattaaaaacaaattaaattttaaaacacctgaagataaattagaagaaattgtgcaccctccacaaaacatacaaagtttaaaagtttggatctttttctcagcaggtatcagttgtaaataatgaattaggggccaaaatgcaaaacgaaaaatgaagcagctacatgtagttagtaatttctagtttgaactgtaattgaatattgtggcttcatatgtattattttatattgtacttttttcattattgatggtttggactttaataagagaaattccatagtttttaatatcccagaagtgagacaatttgaacagtgtattctagaaaacaatacactaactgaacagaagtgaatgcttatatatattatgatagccttaaacctttttcctctaatgccttaactgtcaaataattataaccttttaaagcataggactatagtcagcatgctagactgagaggtaaacactgatgcaattagaacaggtactgatgctgtcagtgtttaacactatgtttagctgtgtttatgctataaaagtgcaatattagacactagctagtactgctgcctcatgtaactccaaagaaaacaggatttcattaagtgcattgaatgtggatatttctctaagttactcatattgtcctttgcttgaatgcaatgccgtgcagatttatgaggctgctatttttattttctgtgcattactttaacaccttaaagggagaagcaaacatttccttcttcagctgactggcaatggccctttaactgcaataggaagaaaaaaaaaaaggtttgtgtgaaaattggtgataactggcacttaagatcgaaaagaaatttctgtatacttgatgccttaagatgcccaaagctgcccaaagctctgaaagactttaagataggcagtaatgcttactacaatactactgagtttttgtagagttaacatttgataataaaacttgcctgtttaatctcaa

SEQ ID NO: 9682 - DNA, 6951 bp, Homo sapiens
cctttgacttccatcaaccccagacctgccgtgttgacccccacagcccctagactgcctcctggtgacttccatactggagaaggcctctgtcttgcacgctcctttgcagaggcctgacgacccctggggaagagtggggggagagcggaagaatgggttagcccccaaaatcaggcaggaccagccctggaagtaggaatccggatcctaagcgtgcgcccaggccgggagcgtgagctcttgcgtcctgggttgagttctggcggccctcccccaaggttcccggagccgccccggtcacgtggccggcggggccggcaggtaactcgcctggagagggcgtgggccggtagccgccccgccccgcggggcgccacgggcgggtcttggcagcgcccactgagccagccgggccgcaggtgccgcccccgatacacggtgtcccgcccaagctgatccgcgtctgcggtcggtcggtgcgtgcgtgcgcctcgtcggtccgcgtgtctggccgagagcccccttcctctgcggccatgactccgccgccgccgccgccccctcccccgggccctgaccccgcggccgaccccgccgcggacccctgcccctggcccggatcactggtcgtcctcttcggggctacggcgggtgcgctgggacgggacctgggctcggacgagaccgacttaatcctcctagtttggcaagtggttgagccgcggagccgccaggtggggacgctgcacaaatcgctggttcgtgccgaggcggccgcactgagtacgcagtgccgcgaggcgagcggcctgagcgccgacagcctggcgcgggcagagccgctggacaaggtgctgcagcagttctcacagctggtgaacggggatgtggctttgctgggcgggggcccctacatgctctgcactgatgggcagcagctattgcgacaggtcctgcaccccgaggcctccaggaagaacctggtgctccccgacatgttcttctccttctatgacctccgaagagaattccatatgcagcatccaagcacctgccctgccagggacctcactgtggccaccatggcacagggtttaggactggagacagatgccacagaggatgactttggggtctgggaagtcaagacaatggtagctgttatcctccatctactcaaagagcccagcagtcaattgttttcgaagcccgaggtgataaagcagaaatacgagacggggccttgcagcaaggctgatgtggtggacagtgagactgtggtacgggctcgtgggttgccgtggcagtcatcagaccaggacgtggctcgcttcttcaaagggctcaacgtggccaggggtggtgtagcactctgcctcaacgcccagggccgcagaaatggcgaggccctcatccgctttgtggacagcgagcagcgggacctagcgctgcagagacacaagcaccacatgggcgtccgctatattgaggtgtataaagcgacaggggaggagtttgtaaagattgcagggggcacatcactagaggtggctcgtttcttgtcacgggaagaccaagtgatcctgcggctgcggggactgcccttctcggctgggccaacggacgtgcttggcttcctggggccagagtgcccagtgactgggggtaccgaggggctgctctttgtgcgccatcctgatggccggccgactggtgatgccttcgccctctttgcttgtgaggagctggcacaggctgcactgcgcaggcacaagggcatgctgggtaagcgatacattgaactcttccggagcactgcagccgaagtgcagcaggtcttgaaccgctatgcatccggcccactccttcctacactgactgccccactgctgcccatccccttcccactggcacctgggactgggagggactgtgtacgcctccgaggcctgccctacacggccaccattgaagacatcctgagctttctgggggaggcagcagctgacattcggccccacggtgtacacatggtgctcaaccagcagggccggccatcgggcgatgccttcattcagatgacatcagcagagcgagccctagctgctgctcagcgttgccataagaaggtgatgaaggagcgctacgtggaggtggtcccctgttccacagaggagatgagccgagtgctgatggggggcaccttgggccgcagtggcatgtcccctccaccctgcaagctgccctgcctctcaccacctacctacaccaccttccaagccaccccaacgctcattcccacggagacggcagctctatacccctcttcagcactgctcccagctgccagggtgcctgctgcccccacccctgttgcctactatccagggccagccactcaactctacctgaactacacagcctactacccaagccccccagtctcccccaccactgtgggctacctcactacacccactgctgccctggcctctgctcccacctcagtgttgtcccagtcaggagccttggtccgcatgcagggtgtcccatacacggctggtatgaaggatctgctcagcgtcttccaggcctaccagctacccgctgatgactacaccagtctgatgcctgttggtgacccacctcgcactgtgttacaagcccccaaggaatgggtgtgtttgtaggagagaaagccaggaggtaagagccagctgatatcctcggcgaacatgtctctcctgagtccagaagaccagcaccctcaacctggtagcttctttctggcttgtcaaagctctcagaaggtacctagaggagcccaagccccagctccatcctccacttattctgcctgtttcccccaaagacaatggctggaccctgcatgcagggctgggggtggaatggggctaaccagctcctgatggcctgagccaggcatcttgactggcacctggagagcccttaagtctgtcctggctgtggcccatgccgacagatatcgtggggctgacaggtccacggcaggcttgctttcttttataaaatggaagctctggtaccttcaatgtatgactcctgggagaatcaagggtccatctgagcctctgagtaaagatcccaatgttctacctctccctgtccctcttgtaggggatagggaggcagagagagccagcccctaccctcagagtatctggacctcagagaccatgttgtgccaggggtggtcccacctaaagatgctagcccctctccaggtgggcataaggagtaacagatggcaaaaccacaaactattttgatggactgtgctgcagtatcaccagaagacattagggggcagtaggcccccacacaaaaccttcaggcttgaattttaaaggggaggactttctgccaacttttcttgtatgccttgggaaagccagttgccctgaacccagcagacaccatggaatgtcctttgcacgcattaaatggtacagaactgaagcctcggaagcaatttggaactcgatcttctcttccttaaatgaaaagttattgaccaaatggactttttaaaagacacaggacccttaactttgccccaaagtgaggggctccacaccaaccccaggcggaggaacactcagacagattaaggatactgttgacctgtcactgtttattatttcagcactaaaactgaggagcctcaactgctggctcttcttccctttgtatttgtgtaaggagcactgcactcccataaaaggttttaaaatacaaaatgtacaagaacacacaattccaagtgctgtaaacataactgagaaccagttcctttactaaacatccattttataaaacacaaggtttcaatttgagcccatctgagccttaaagatccattctgaataccaaaaacagggcttcacagccaggcccagaagaggtctggtgataatggctggccctgggtggggatagtttacacccgggcagcagcaccacacatgaacccaaagacatgttctttttaaagctgttttcagccatgtttctctgtgcatctccagtaagcagaaggctacccattccattcctcaacccaagagctagcacagttagagtaggagggggtgcgtactagcacgtgcccagttgctcagtgctgctagtagaaattgatttgcatagtccaatggatgtgtgctttaacaccactatgttgcacaaaaatttaagtctttatctacaaagccaaaaaatattgactcttaacaccaaagcttttacaaagctgatataaaactgcttacatagtatacaaagctctattttaaaatttaatgtttattttaaataggaaagcatttctagtgctacaggcatcaaggtatttagaaggcatcaaaatttggtgcatagcaactctggatcatagaggcttttaattcttgagggcacaaagggtattgcaaggggaactcttgcaataacctcatgtgaggcagctacaccaggggcaaaagggtaggggcaagtctggccatttctctggaatgtcaaccgagaggccaacttcttgcccctccaaaggaagctgtgggcgtccaaccacaggcccagaagcaaatctcactatccacattctgtgacacaactcacttttcaagaaaatttgaaaacacccagctccaagaggggccacagtgatctgctgaagaatagacctttttctctaactaactttaggggagaaatctaaaatatattttgttttttttaaagaccatacttcctcatcctgagtcaacagctcctaacctactgacaacaggtggtgggcaataggccagctccctttcccagacctgaactggccttagtagagagagtcctggcatcaagggcctgcagtctcctggaataacagcatcaggccttcaaccagcacactgtctcacatataggcactcaaaaaatctgcttcctgaatcaatggaagtatattatttcatttgaaagcatactgcaaacttcagaggctctgtaatgggcccaggaacaggtaaaaaaaatcccattagggagaggggtaagggcaggttttttttttttttaaagtacccaactcgggtacctcctttggtagacagcaggctgcagtttctgctgggccctgccttggacaccagtctcaccagcagcagcaccagggtgtctttggtgtggagggtcaggttatcacttctggatgtgctcagagccttctggggaaaaggctggtttttagatcatacagacaggacagggtaggccagaatcatttcaggctataaatagaatggcagataagccttccatgccagtgtgactcttaaaaccttcccatctggagtcctgtattttctctgcccatgctgatgtactgctcatttgtgctttagctctgcacacagcctggcctctagctagagttagaactgcaaagctgcctaaaccactgagactggcttcaaaggtcacagaacagccaaaggcagatgcttctgtttggaaaaggttctacgaccagatgacacaaacaggaagcgcactccacagcctactagtttttatgatggcaagaaatgaaagtgaccaagctagaaccccaccattcagagtcaccttaaatgtagccatcttacccagggtcctgagggaaaaagcaatttcaacatggagccagtatggagagattgcaagattacctagaaagttaccaaaaggctatgctctggaatgtctttttatattccaacacttcaatgatggaatggtctcttctcattttatctaacaacagtttagttttataaagaggtatgagctacatttggctttatttcctataaatctatgaacgtcttcaggacacatgctgactttctgaggcataggtgtgggcttgggatatttttttctttttctttttttcttttctttttttttcttttttttttttttttttttttttttgcttctagaaggtcttatcaaaagttcctattttaaaaattatcataaaaactaaagggcccttcaaatgaccataaagcagtacaaatcaccaatcctagctaagtaaccaggtcacctgcaaaagcagcacctcggaaacaagagagcctgctgcattcacactcaaagcacccatcatataaaagtatcctagttaaatataaaaagcaaagttcatttccccaaagctcaaacagcctatgctgctcctgttcttttgccaaatctacccaaggcctgaggtggaggaatgctactttccccacaaatggtgggtcccactcctggccccagacctgaaggctgcagagttggaaacccaaggtccaaggagagaaacatgctgagaagttggtggtggacacaaggctgcagtaagcactgttagagcccatcagatcttcctaaatccagggactcaggactcgggaggggagcctgcctgctcacccctgctccttgggaaacagaaatctgggacatgtctctcccaattatctcgttcactgaaaaacaagaaaagggagagtgattagtgacctctgagtgattagccatatgatgcccaacgctgagctctacctcagacatttcccttcccatggctttctgtaaagataaaggcagtgtctgaagcctgctcctgagctgagtggcattagagatggaaacatcgctccacaaactactctggacctctttttctctctcattcagttcattttgggttgggaagggggcttaccctcactctaaaggtatgtttaaataagtattcaccttactctaacttttctttaattcatatctctttgagaaagtttttattttctacaatgccacctcctatgtaaatggaatgaaaataaatgctttggtcagaataaa

SEQ ID NO: 9683 - DNA, 3114 bp, Homo sapiens
ggaatcccatcttgagactcgctaagcgtcccagccgcatccctcccgcagcgacggcggcccgggacccgcgggctgtgaaccatgaacacccgcaatagagtggtgaactccgggctcggcgcctcccctgcctcccgcccgacccgggatccccaggacccttctgggcggcaaggggagctgagccccgtggaagaccagagagagggtttggaggcagcccctaagggcccttcgcgggagagcgtcgtgcacgcgggccagaggcgcacaagtgcatacaccttgatagcaccaaatataaaccggagaaatgagatacaaagaattgcggagcaggagctggccaacctggagaagtggaaggagcagaacagagctaaaccggttcacctggtgcccagacggctaggtggaagccagtcagaaactgaagtcagacagaaacaacaactccagctgatgcaatctaaatacaagcaaaagctaaaaagagaagaatctgtaagaatcaagaaggaagctgaagaagctgaactccaaaaaatgaaggcaattcagagagagaagagcaataaactggaggagaaaaaaagacttcaagaaaaccttagaagagaagcatttagagagcatcagcaatacaaaaccgctgagttcttgagcaaactgaacacagaatcgccagacagaagtgcctgtcaaagtgctgtttgtggcccacaatcctcaacatgggccagaagctgggcttacagagattctctaaaggcagaagaaaacagaaaattgcaaaagatgaaggatgaacaacatcaaaagagtgaattactggaactgaaacggcagcagcaagagcaagaaagagccaaaatccaccagactgaacacaggagggtaaataatgcttttctggaccgactccaaggcaaaagtcaaccaggtggcctcgagcaatctggaggctgttggaatatgaatagcggtaacagctggggtatatgagaaaatattgactcctatctggccttcatcaactgacctcgaaaagcctcatgagatgctttttcttaatgtgattttgttcagcctcactgtttttaccttaatttcaactgcccacacacttgaccgtgcagtcaggagtgactggcttctccttgtcctcatttatgcatgtttggaggagctgattcctgaactcatatttaatctctactgccagggaaatgctacattatttttctaattggaagtataattagagtgatgttggtagggtagaaaaagagggagtcacttgatgctttcaggttaatcagagctatgggtgctacaggcttgtctttctaagtgacatattcttatctaattctcagatcaggttttgaaagctttgggggtctttttagattttaatccctactttctttatggtacaaatatgtacaaaagaaaaaggtcttatattcttttacacaaatttataaataaattttgaactccttctgtataaatgggtcatttttatttttaatgaaaagttattggggttttctctcttgaagggtctcattttaattcccttttccaggccgtatagatcaaatatagtactgtcattactgttggctcttgttttggtcttgacttactaatagtgttaccctgattttcagagggggacagtttatctccagaaaggccaatgtttgtatacacatcagctagacacaaatatagacatcatatgtagtttgtacatgtttcagaaacttgttttttctttgctctgtgtaacctatttcctattgctagttcagttggctttcttattcacttctgtgaccctgaaccagttctcagaccctagagtgtaagagcattgattttctacgctgtgtaatctagctcaatccctctgtcccctccgcctcaccgtcccccagccaccacattgtatagcaaaagcattacattcaatcctagaataaaggtaaatacaacaaatcatctttgcagctggacaactaataatactttgcagcattaagagatcttctgtgttaccagtcactctgttgaaatgaactttccgaatctctttattcaggaaaacatggggttttgaaattcttgggccaagagacataactgaggggttcgcagagctaggcaagggtgcactaggaaagggccacattggtgggtggggggtaacagagaacagatggtgtcaggaagtttctctggagtaaataatgtggatattcttggtttccctctcctccgccagctgaagctgtgttagtgctgttgacactaatataaaatgtttggtccatttgaaatccttgtcattgccttatatgggggaaactcaatcccccagcctgtgttggaaatatcaccaaactgattgtaaatgtgcggctgtagcagacattttagtgtggtggtgtgcagccatttcggccctacacctgccagcctggctaccttacagttgtgttccgatttttgcgtctatgcttggtgtgcctcacttgctgcattttccagcatgcaaccaggagttgacgtaggaaaaagggatgctttcttactttggaagctctcagggaagttggtgtcaatttctcctccactgcctggcctaccctgcactcccaaagattttgtgcagatgggtagttccattttttaaaaattgtgcagatatggaaaattgtgacttacttcatgaccagaactatctagaatatgtgtgggggtataaacatcttgcttaaccaaatatctatgtaggcagaggtaaccaggagagaagcaagacttgctgcctaaaggagcccaccattttacttttcacatttaatctgccacgttgaatcaattggaataaaacctgactcgcaggtgactggacaggaaatcccaaagttccaccatttctatgcttaattttaatgtccccccgcttttttttttgtagaaaataaaaacaagaaaatcgttccaatgtaagatgtttgttatagaaactttaggcaatacaggtgtgtaataaaatgtttaataaacttctaaacacttttgtatttggattta

SEQ ID NO: 9684 - DNA, 3160 bp, Homo sapiens
cgctaagcgtcccagccgcatccctcccgcagcgacggcggcccgggacccgcgggctgtgaaccatgaacacccgcaatagagtggtgaactccgggctcggcgcctcccctgcctcccgcccgacccgggatccccaggacccttctgggcggcaaggggagctgagccccgtggaagaccagagagagggtttggaggcagcccctaagggcccttcgcgggagagcgtcgtgcacgcgggccagaggcgcacaagtgcatacaccttgatagcaccaaatataaaccggagaaatgagatacaaagaattgcggagcaggagctggccaacctggagaagtggaaggagcagaacagagctaaaccggttcacctggtgcccagacggctaggtggaagccagtcagaaactgaagtcagacagaaacaacaactccagctgatgcaatctaaatacaagcaaaagctaaaaagagaagaatctgtaagaatcaagaaggaagctgaagaagctgaactccaaaaaatgaaggcaattcagagagagaagagcaataaactggaggagaaaaaaagacttcaagaaaaccttagaagagaagcatttagagagcatcagcaatacaaaaccgctgagttcttgagcaaactgaacacagaatcgccagacagaagtgcctgtcaaagtgctgtttgtggcccacaatcctcaacatggaaacttcctatcctgcctagggatcacagctgggccagaagctgggcttacagagattctctaaaggcagaagaaaacagaaaattgcaaaagatgaaggatgaacaacatcaaaagagtgaattactggaactgaaacggcagcagcaagagcaagaaagagccaaaatccaccagactgaacacaggagggtaaataatgcttttctggaccgactccaaggcaaaagtcaaccaggtggcctcgagcaatctggaggctgttggaatatgaatagcggtaacagctggggttctctattagttttttcgaggcacctaagggtatatgagaaaatattgactcctatctggccttcatcaactgacctcgaaaagcctcatgagatgctttttcttaatgtgattttgttcagcctcactgtttttaccttaatttcaactgcccacacacttgaccgtgcagtcaggagtgactggcttctccttgtcctcatttatgcatgtttggaggagctgattcctgaactcatatttaatctctactgccagggaaatgctacattatttttctaattggaagtataattagagtgatgttggtagggtagaaaaagagggagtcacttgatgctttcaggttaatcagagctatgggtgctacaggcttgtctttctaagtgacatattcttatctaattctcagatcaggttttgaaagctttgggggtctttttagattttaatccctactttctttatggtacaaatatgtacaaaagaaaaaggtcttatattcttttacacaaatttataaataaattttgaactccttctgtataaatgggtcatttttatttttaatgaaaagttattggggttttctctcttgaagggtctcattttaattcccttttccaggccgtatagatcaaatatagtactgtcattactgttggctcttgttttggtcttgacttactaatagtgttaccctgattttcagagggggacagtttatctccagaaaggccaatgtttgtatacacatcagctagacacaaatatagacatcatatgtagtttgtacatgtttcagaaacttgttttttctttgctctgtgtaacctatttcctattgctagttcagttggctttcttattcacttctgtgaccctgaaccagttctcagaccctagagtgtaagagcattgattttctacgctgtgtaatctagctcaatccctctgtcccctccgcctcaccgtcccccagccaccacattgtatagcaaaagcattacattcaatcctagaataaaggtaaatacaacaaatcatctttgcagctggacaactaataatactttgcagcattaagagatcttctgtgttaccagtcactctgttgaaatgaactttccgaatctctttattcaggaaaacatggggttttgaaattcttgggccaagagacataactgaggggttcgcagagctaggcaagggtgcactaggaaagggccacattggtgggtggggggtaacagagaacagatggtgtcaggaagtttctctggagtaaataatgtggatattcttggtttccctctcctccgccagctgaagctgtgttagtgctgttgacactaatataaaatgtttggtccatttgaaatccttgtcattgccttatatgggggaaactcaatcccccagcctgtgttggaaatatcaccaaactgattgtaaatgtgcggctgtagcagacattttagtgtggtggtgtgcagccatttcggccctacacctgccagcctggctaccttacagttgtgttccgatttttgcgtctatgcttggtgtgcctcacttgctgcattttccagcatgcaaccaggagttgacgtaggaaaaagggatgctttcttactttggaagctctcagggaagttggtgtcaatttctcctccactgcctggcctaccctgcactcccaaagattttgtgcagatgggtagttccattttttaaaaattgtgcagatatggaaaattgtgacttacttcatgaccagaactatctagaatatgtgtgggggtataaacatcttgcttaaccaaatatctatgtaggcagaggtaaccaggagagaagcaagacttgctgcctaaaggagcccaccattttacttttcacatttaatctgccacgttgaatcaattggaataaaacctgactcgcaggtgactggacaggaaatcccaaagttccaccatttctatgcttaattttaatgtccccccgcttttttttttgtagaaaataaaaacaagaaaatcgttccaatgtaagatgtttgttatagaaactttaggcaatacaggtgtgtaataaaatgtttaataaacttctaaacacttttgtatttggattta

SEQ ID NO: 9685 - DNA, 1660 bp, Homo sapiens
gaaaactagccgaggagagccagggagccggagagatcgcgcgcctgccgccgccggagcctgcgagccgagaccgagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatgacccacccctctccccccgcctgccacctccccccacaagtgccctccaggcttttcttggggaagataccccttttctgaggaatgagtttgcctccgtcccctgcccatgctgggagcccacgctcaccccctcacccctccaagctcactccccaacccccaactccgtgtggtaagcaacatggctttgatgataaacgactttactct

SEQ ID NO: 9686 - DNA, 1776 bp, Homo sapiens
acaggcccttagagcatcgccaggtgcagagctccacagctctctttcccaaggagtaatcagagggtgagaacgtggagcctggtggacaggtgaaagcactgggatctttctgcccagaaaggggaaagttgcacatttatatcctagagggaagcgacagcagtgcttctccctgtgctgaggtacaggagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatgacccacccctctccccccgcctgccacctccccccacaagtgccctccaggcttttcttggggaagataccccttttctgaggaatgagtttgcctccgtcccctgcccatgctgggagcccacgctcaccccctcacccctccaagctcactccccaacccccaactccgtgtggtaagcaacatggctttgatgataaacgactttactct

SEQ ID NO: 9687 - DNA, 567 bp, Homo sapiens
gctgaaaactagccgaggagagccagggagccggagagatcgcgcgcctgccgccgccggagcctgcgagccgagaccgagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcc

SEQ ID NO: 9688 - DNA, 895 bp, Homo sapiens
cgcgcctgccgccgccggagcctgcgagccgagaccgtaagcgcccggggccggccgggcccgcactccccggacgcagacgcggttcgggctccgcgcgggctcggccgccggggtgggcggcgggccggggcgccgaggggtcggggctgcggtcggcccgcaggggtgcagagggacttgtagttggtccgcccccagctcctgccccggccaggagactgcgcgtgccgcctactgggggaaggagcctgcaggcgaccgcggacttctcgcagggaattccgcgtcccagactgtgggcggacgccgcagggagggaggctcgcgaccccgagagcgcaccgcgtcccctggcctgggcgagctctgcttccagggccgtggctcgctcggcggtgaaatgcacttaatttgtcacccaagtcggaacactgattttcatgcgcgtccgtgtgaagagaccaccaaacaggctttgtgagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgccc

SEQ ID NO: 9689 - DNA, 2064 bp, Homo sapiens
aggttagctgcgtgtccgggtgctaggctgcagacccgccgccatgacgctgcgcgcggccgtcttcgaccttgacggggtgctggcgctgccagcggtgttcggcgtcctcggccgcacggaggaggccctggcgctgcccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccagcttctcaataccccggcccctctgccgacctcttgcaatccaagtgacatgagccatgggtacgtgacagtaaagcccagggtccgtctgcattttgtggagctgggctccggccctgctgtgtgcctctgccatggatttcccgagagttggtattcttggaggtaccagatccctgctctggcccaggcaggttaccgggtcctagctatggacatgaaaggctatggagagtcatctgctcctcccgaaatagaagaatattgcatggaagtgttatgtaaggagatggtaaccttcctggataaactgggcctctctcaagcagtgttcattggccatgactggggtggcatgctggtgtggtacatggctctcttctaccccgagagagtgagggcggtggccagtttgaatactcccttcataccagcaaatcccaacatgtcccctttggagagtatcaaagccaacccagtatttgattaccagctctacttccaagaaccaggagtggctgaggctgaactggaacagaacctgagtcggactttcaaaagcctcttcagagcaagcgatgagagtgttttatccatgcataaagtctgtgaagcgggaggactttttgtaaatagcccagaagagcccagcctcagcaggatggtcactgaggaggaaatccagttctatgtgcagcagttcaagaagtctggtttcagaggtcctctaaactggtaccgaaacatggaaaggaactggaagtgggcttgcaaaagcttgggacggaagatcctgattccggccctgatggtcacggcggagaaggacttcgtgctcgttcctcagatgtcccagcacatggaggactggattccccacctgaaaaggggacacattgaggactgtgggcactggacacagatggacaagccaaccgaggtgaatcagatcctcattaagtggctggattctgatgcccggaacccaccggtggtctcaaagatgtagaacgcagcgtgtgcccacgctcagcaggtgtgccatccttccacctgctggggcaccattcttagtatacagaggtggccttacacacatcttgcatggatggcagcattgttctgaaggggtttgcagaaaaaaaagattttctttacataaagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatg

SEQ ID NO: 9690 - DNA, 2038 bp, Homo sapiens
cttcgcgcatctcccaggttagctgcgtgtccgggtgctaggctgcagacccgccgccatgacgctgcgcgcggccgtcttcgaccttgacggggtgctggcgctgccagcggtgttcggcgtcctcggccgcacggaggaggccctggcgctgcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccagcttctcaataccccggcccctctgccgacctcttgcaatccaagtgacatgagccatgggtacgtgacagtaaagcccagggtccgtctgcattttgtggagctgggctccggccctgctgtgtgcctctgccatggatttcccgagagttggtattcttggaggtaccagatccctgctctggcccaggcaggttaccgggtcctagctatggacatgaaaggctatggagagtcatctgctcctcccgaaatagaagaatattgcatggaagtgttatgtaaggagatggtaaccttcctggataaactgggcctctctcaagcagtgttcattggccatgactggggtggcatgctggtgtggtacatggctctcttctaccccgagagagtgagggcggtggccagtttgaatactcccttcataccagcaaatcccaacatgtcccctttggagagtatcaaagccaacccagtatttgattaccagctctacttccaagaaccaggagtggctgaggctgaactggaacagaacctgagtcggactttcaaaagcctcttcagagcaagcgatgagagtgttttatccatgcataaagtctgtgaagcgggaggactttttgtaaatagcccagaagagcccagcctcagcaggatggtcactgaggaggaaatccagttctatgtgcagcagttcaagaagtctggtttcagaggtcctctaaactggtaccgaaacatggaaaggaactggaagtgggcttgcaaaagcttgggacggaagatcctgattccggccctgatggtcacggcggagaaggacttcgtgctcgttcctcagatgtcccagcacatggaggactggattccccacctgaaaaggggacacattgaggactgtgggcactggacacagatggacaagccaaccgaggtgaatcagatcctcattaagtggctggattctgatgcccggaacccaccggtggtctcaaagatgtagaacgcagcgtgtgcccacgctcagcaggtgtgccatccttccacctgctggggcaccattcttagtatacagaggtggccttacacacatcttgcatggatggcagcattgttctgaaggggtttgcagaaaaaaaagattttctttacataaagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatgactatg

SEQ ID NO: 9691 - DNA, 1930 bp, Homo sapiens
gtgctaggctgcagacccgccgccatgacgctgcgcgcggccgtcttcgaccttgacggggtgctggcgctgccagcggtgttcggcgtcctcggccgcacggaggaggccctggcgctgcccagaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaagctttttgctcaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccagcttctcaataccccggcccctctgccgacctcttgcaatccaagtgacatgagccatgggtacgtgacagtaaagcccagggtccgtctgcattttgtggagctgggctccggccctgctgtgtgcctctgccatggatttcccgagagttggtattcttggaggtaccagatccctgctctggcccaggcaggttaccgggtcctagctatggacatgaaaggctatggagagtcatctgctcctcccgaaatagaagaatattgcatggaagtgttatgtaaggagagtatcaaagccaacccagtatttgattaccagctctacttccaagaaccaggagtggctgaggctgaactggaacagaacctgagtcggactttcaaaagcctcttcagagcaagcgatgagagtgttttatccatgcataaagtctgtgaagcgggaggactttttgtaaatagcccagaagagcccagcctcagcaggatggtcactgaggaggaaatccagttctatgtgcagcagttcaagaagtctggtttcagaggtcctctaaactggtaccgaaacatggaaaggaactggaagtgggcttgcaaaagcttgggacggaagatcctgattccggccctgatggtcacggcggagaaggacttcgtgctcgttcctcagatgtcccagcacatggaggactggattccccacctgaaaaggggacacattgaggactgtgggcactggacacagatggacaagccaaccgaggtgaatcagatcctcattaagtggctggattctgatgcccggaacccaccggtggtctcaaagatgtagaacgcagcgtgtgcccacgctcagcaggtgtgccatccttccacctgctggggcaccattcttagtatacagaggtggccttacacacatcttgcatggatggcagcattgttctgaaggggtttgcagaaaaaaaagattttctttacataaagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatgactatg

SEQ ID NO: 9692 - DNA, 3140 bp, Homo sapiens
attccaagtccagcaagttcgcagggagctgtcagtccgtccaggaaggcccgggcctgggtttgcctcttcaagcagctactgcaggggcgtggggagggggcataagagactttggactttcctttgagacagtagaaagcgttacatccagaggcgagattctagcctggggtccccgccttcccggcctcctcttcctctccctctgactccctttcctgtgcccctccccctgcctctttcccggccagagtccagccttaacccgggcagagggcggagtcccgttaagggggtgtggggaggaggcggggccagggcaggggcggggcagagccgggccaagctgggcgggtcatgcgccctggccttcgcgcatctcccaggttagctgcgtgtccgggtgctaggctgcagacccgccgccatgacgctgcgcgcggccgtcttcgaccttgacggggtgctggcgctgccagcggtgttcggcgtcctcggccgcacggaggaggccctggcgctgcccagaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccagcttctcaataccccggcccctctgccgacctcttgcaatccaagtgacatgagccatgggtacgtgacagtaaagcccagggtccgtctgcattttgtggagctgggctccggccctgctgtgtgcctctgccatggatttcccgagagttggtattcttggaggtaccagatccctgctctggcccaggcaggttaccgggtcctagctatggacatgaaaggctatggagagtcatctgctcctcccgaaatagaagaatattgcatggaagtgttatgtaaggagatggtaaccttcctggataaactgggcctctctcaagcagtgttcattggccatgactggggtggcatgctggtgtggtacatggctctcttctaccccgagagagtgagggcggtggccagtttgaatactcccttcataccagcaaatcccaacatgtcccctttggagagtatcaaagccaacccagtatttgattaccagctctacttccaagaaccaggagtggctgaggctgaactggaacagaacctgagtcggactttcaaaagcctcttcagagcaagcgatgagagtgttttatccatgcataaagtctgtgaagcgggaggactttttgtaaatagcccagaagagcccagcctcagcaggatggtcactgaggaggaaatccagttctatgtgcagcagttcaagaagtctggtttcagaggtcctctaaactggtaccgaaacatggaaaggaactggaagtgggcttgcaaaagcttgggacggaagatcctgattccggccctgatggtcacggcggagaaggacttcgtgctcgttcctcagatgtcccagcacatggaggactggattccccacctgaaaaggggacacattgaggactgtgggcactggacacagatggacaagccaaccgaggtgaatcagatcctcattaagtggctggattctgatgcccggaacccaccggtggtctcaaagatgtagaacgcagcgtgtgcccacgctcagcaggtgtgccatccttccacctgctggggcaccattcttagtatacagaggtggccttacacacatcttgcatggatggcagcattgttctgaaggggtttgcagaaaaaaaagattttctttacataaagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatgactatgctgctggctgtctttgttcttggagaggtggagtgactgttcacggagaatgcacggcatggggatgaaccctttccctctgcttttgagccctgttctgggctccaaggtgctgtatgatctaggccgtgctggccaggagacaatcctatggggatggcagtggtgtcttgtgctctgtcccctagagcagtcactggccacaggtagccacctgcctttctcccggcttccctagcagagtttgctcaggcacaaatgtgcacctggagcatttgaaatgtgctagtgaggctgaggaagagaattttaaatttcattgaattgtaatcagtttaaagttaaatagcagcagctgccatgaggctcaggcagatccagctcatcttcccctctgccccctcctccctatcttcccctctaccctctcctgcctcctgtcacatccggttaggctcccatctcactgatgtgtctcctgcagtggtctctcccctgccctgcttccagccccagagtcctggagcagcagcctcctcacgggtcttgccgcccacatggttggatcctgaaactcgcagggcctcccccaactgcccctgcccacccccagcccggccccatcaccctccaattcctaaccgc

SEQ ID NO: 9693 - DNA, 2405 bp, Homo sapiens
gcaatttccgcttccggtccgtcgcctccttctgttgcttcccgtctcctcggcggctcccctcccccgcccggctctccgcgccccttctgggcggcggggcggcggagccgtcggcgtgcggccctccttgcgttcgtgcgtgcgcccgtggcccggcgcacgtcccgcgacaccgaggccgagcggggcagggggctgaccgccatgaccccccagagcccggcgtgagggggccgagatgcggtgacctgccagcacctgccgcagccttcgtccgggagtcgccccatctctccacgcatcggggccctgtgccccttgctgctgcagccgggcaccatgtcgacctcgtccttgaggcgccagatgaagaacatcgtccacaactactcagaggcggagatcaaggttcgagaggccacgagcaatgacccctggggcccatccagctccctcatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccaggaggagcggatccgtcgcggggatgacctgcggctgcagatggcaatcgaggagagcaagagggagactgggggcaaggaggagtcgtccctcatggaccttgctgacgtcttcacggccccagctcctgccccgaccacagacccctgggggggcccagcacccatggctgctgccgtccccacggctgcccccacctcggacccctggggcggcccccctgtccctccagctgctgatccctggggaggtccagcccccacgccggcctctggggacccctggaggcctgctgcccctgcaggaccctcagttgacccttggggtgggaccccagcccctgcagctggggaggggcccacgcctgatccatggggaagttccgatggtggggtcccggtcagtgggccctcagcctccgatccctggacaccggccccggccttctcagatccctggggagggtcacctgccaagcccagcaccaatggcacaacagccgggggattcgacacggagcccgacgagttctctgactttgaccgactccgcacggcactgccgacctccgggagcagcgcaggagagctggagctgctggcaggagaggtgccggcccgaagccctggggcgtttgacatgagtggggtcaggggatctctggctgaggctgtgggcagccccccacctgcagccacaccaactcccacgccccccacccggaagacgccggagtcattcctggggcccaatgcagccctcgtcgacctggactcgctggtgagccggccgggccccacgccgcctggagccaaggcctccaaccccttcctgccaggcggaggcccagccactggcccttccgtcaccaaccccttccagcccgcgcctcccgcgacgctcaccctgaaccagctccgtctcagtcctgtgcctcccgtccctggagcgccacccacgtacatctctccccttggcgggggccctggcctgccccccatgatgcccccgggccccccggcccccaacactaatcccttcctcctataatccagggcggaagggggcctggctccatccggctgccccattccggctccctgggagatcagtgttgtgagtgcatgtgaaatgggggatccccacccccagtgcccttccccttcctggggcccactcacactacaccctcttcctttcccaccccacctccccggagagaaactggacatggggcctggggaggggagctggccagaggaggacccctttcccgtggcattagaagggggaggggtggctggggcccccacccattccccctccctccaaactcccaacccccagtcagtgtttgagcctcctcgttcccctcacgcacccgctcacgcaccctcggtgaatccttggtgatgattttggcaactttgggaataaatggcaattcccacgggcttggc

SEQ ID NO: 9694 - DNA, 2483 bp, Homo sapiens
gcaatttccgcttccggtccgtcgcctccttctgttgcttcccgtctcctcggcggctcccctcccccgcccggctctccgcgccccttctgggcggcggggcggcggagccgtcggcgtgcggccctccttgcgttcgtgcgtgcgcccgtggcccggcgcacgtcccgcgacaccgaggccgagcggggcagggggctgaccgccatgaccccccagagcccggcgtgagggggccgagatgcggtgacctgccagcacctgccgcagccttcgtccgggagtcgccccatctctccacgcatcggggccctgtgccccttgctgctgcagccgggcaccatgtcgacctcgtccttgaggcgccagatgaagaacatcgtccacaactactcagaggcggagatcaaggttcgagaggccacgagcaatgacccctggggcccatccagctccctcatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccagcccccgtcctgcggccccgaggacgacgcccagctccagctggcccttagtttgagccgagaagagcatgataaggaggagcggatccgtcgcggggatgacctgcggctgcagatggcaatcgaggagagcaagagggagactgggggcaaggaggagtcgtccctcatggaccttgctgacgtcttcacggccccagctcctgccccgaccacagacccctgggggggcccagcacccatggctgctgccgtccccacggctgcccccacctcggacccctggggcggcccccctgtccctccagctgctgatccctggggaggtccagcccccacgccggcctctggggacccctggaggcctgctgcccctgcaggaccctcagttgacccttggggtgggaccccagcccctgcagctggggaggggcccacgcctgatccatggggaagttccgatggtggggtcccggtcagtgggccctcagcctccgatccctggacaccggccccggccttctcagatccctggggagggtcacctgccaagcccagcaccaatggcacaacagcagccgggggattcgacacggagcccgacgagttctctgactttgaccgactccgcacggcactgccgacctccgggagcagcgcaggagagctggagctgctggcaggagaggtgccggcccgaagccctggggcgtttgacatgagtggggtcaggggatctctggctgaggctgtgggcagccccccacctgcagccacaccaactcccacgccccccacccggaagacgccggagtcattcctggggcccaatgcagccctcgtcgacctggactcgctggtgagccggccgggccccacgccgcctggagccaaggcctccaaccccttcctgccaggcggaggcccagccactggcccttccgtcaccaaccccttccagcccgcgcctcccgcgacgctcaccctgaaccagctccgtctcagtcctgtgcctcccgtccctggagcgccacccacgtacatctctccccttggcgggggccctggcctgccccccatgatgcccccgggccccccggcccccaacactaatcccttcctcctataatccagggcggaagggggcctggctccatccggctgccccattccggctccctgggagatcagtgttgtgagtgcatgtgaaatgggggatccccacccccagtgcccttccccttcctggggcccactcacactacaccctcttcctttcccaccccacctccccggagagaaactggacatggggcctggggaggggagctggccagaggaggacccctttcccgtggcattagaagggggaggggtggctggggcccccacccattccccctccctccaaactcccaacccccagtcagtgtttgagcctcctcgttcccctcacgcacccgctcacgcaccctcggtgaatccttggtgatgattttggcaactttgggaataaatggcaattcccacgggcttggc

SEQ ID NO: 9695 - DNA, 2946 bp, Homo sapiens
aattctttcatttcagagttgagcaaactgtgtctcaaggaggtgtgcgctgcaggtagctgatgtggccaggatttgaacccacattttatattctttgccattagattccatttttcttatctcttatttctcagcgccaggtctctttttgtttctgggcctctttcttccttggcctcctgcctccctgtcttcccatgttcttgtatctgctgctgcctgtgtttttctcattgtgtctctgcctagctccctctgcccaggtttctatgtgtctctttctgtcagaactgtcttctatttcttctcagtccccttctctgcatttgttacatcatctcttcatcttaatgtattaggctggggctgttttgggactccagagagttactttttaactagctacatctgtcttcaggtgcctggctttctggcctgaggtggaagcagaggccagcctctctccgtcatccctatctcccctgggcttacatcatggcggggctttgaaaatctccctctgtggcttcttggagccgcatagatgggtgatcagagctggctctggaaccaggctgctccaggagtaaggagcccagtctttgcatgcagtgttgaaaaaggtaatgtccctcttgtgctgagcgagcacctggcacacagcagggacccaggcagtggggctgttaggttccttatctctcctgagccttgggcttccgctatccttgggacgtctggtcttctggcttccccggttcttcctgccgccctggatgcggtgacctgccagcacctgccgcagccttcgtccgggagtcgccccatctctccacgcatcggggccctgtgccccttgctgctgcagccgggcaccatgtcgacctcgtccttgaggcgccagatgaagaacatcgtccacaactactcagaggcggagatcaaggttcgagaggccacgagcaatgacccctggggcccatccagctccctcatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccaggaggagcggatccgtcgcggggatgacctgcggctgcagatggcaatcgaggagagcaagagggagactgggggcaaggaggagtcgtccctcatggaccttgctgacgtcttcacggccccagctcctgccccgaccacagacccctgggggggcccagcacccatggctgctgccgtccccacggctgcccccacctcggacccctggggcggcccccctgtccctccagctgctgatccctggggaggtccagcccccacgccggcctctggggacccctggaggcctgctgcccctgcaggaccctcagttgacccttggggtgggaccccagcccctgcagctggggaggggcccacgcctgatccatggggaagttccgatggtggggtcccggtcagtgggccctcagcctccgatccctggacaccggccccggccttctcagatccctggggagggtcacctgccaagcccagcaccaatggcacaacagcagccgggggattcgacacggagcccgacgagttctctgactttgaccgactccgcacggcactgccgacctccgggagcagcgcaggagagctggagctgctggcaggagaggtgccggcccgaagccctggggcgtttgacatgagtggggtcaggggatctctggctgaggctgtgggcagccccccacctgcagccacaccaactcccacgccccccacccggaagacgccggagtcattcctggggcccaatgcagccctcgtcgacctggactcgctggtgagccggccgggccccacgccgcctggagccaaggcctccaaccccttcctgccaggcggaggcccagccactggcccttccgtcaccaaccccttccagcccgcgcctcccgcgacgctcaccctgaaccagctccgtctcagtcctgtgcctcccgtccctggagcgccacccacgtacatctctccccttggcgggggccctggcctgccccccatgatgcccccgggccccccggcccccaacactaatcccttcctcctataatccagggcggaagggggcctggctccatccggctgccccattccggctccctgggagatcagtgttgtgagtgcatgtgaaatgggggatccccacccccagtgcccttccccttcctggggcccactcacactacaccctcttcctttcccaccccacctccccggagagaaactggacatggggcctggggaggggagctggccagaggaggacccctttcccgtggcattagaagggggaggggtggctggggcccccacccattccccctccctccaaactcccaacccccagtcagtgtttgagcctcctcgttcccctcacgcacccgctcacgcaccctcggtgaatccttggtgatgattttggcaactttgggaataaatggcaattcccacgggcttggc

SEQ ID NO: 9696 - DNA, 2057 bp, Homo sapiens
ttccggtccgtcgcctccttctgttgcttcccgtctcctcggcggctcccctcccccgcccggctctccgcgccccttctgggcggcggggcggcggagccgtcggcgtgcggccctccttgcgttcgtgcgtgcgcccgtggcccggcgcacgtcccgcgacaccgaggccgagcggggcagggggctgaccgccatgaccccccagagcccggcgtgagggggccgagatgcggtgacctgccagcacctgccgcagccttcgtccgggagtcgccccatctctccacgcatcggggccctgtgccccttgctgctgcagccgggcaccatgtcagagattgccgacctcacctacaacgttgtcgccttctcggagatcatgagcatgatctggaagcggctcaatgaccatggcaagaactggcgtcacgtttacaaggccatgacgctgatggagtacctcatcaagaccggctcggagcgcgtgtcgcagcagtgcaaggagaacatgtacgccgtgcagacgctgaaggacttccagtacgtggaccgcgacggcaaggaccagggcgtgaacgtgcgtgagaaagctaagcagctggtggccctgctgcgcgacgaggaccggctgcgggaagagcgggcgcacgcgctcaagaccaaggaaaagctggcacagaccgccacggcctcatcagcagctgtgggctcaggcccccctcccgaggcggagcaggcgtggccgcagagcagcggggaggaggagctgcagctccagctggccctggccatgagcaaggaggaggccgaccagcccccgtcctgcggccccgaggacgacgcccagctccagctggcccttagtttgagccgagaagagcatgataaggaggagcggatccgtcgcggggatgacctgcggctgcagatggcaatcgaggagagcaagagggagactgggggcaaggaggagtcgtccctcatggaccttgctgacgtcttcacggccccagctcctgccccgaccacagacccctgggggggcccagcacccatggctgctgccgtccccacggctgcccccacctcggacccctggggcggcccccctgtccctccagctgctgatccctggggaggtccagcccccacgccggcctctggggacccctggaggcctgctgcccctgcaggaccctcagttgacccttggggtgggaccccagcccctgcagctggggaggggcccacgcctgatccatggggaagttccgatggtggggtcccggtcagtgggccctcagcctccgatccctggacaccggccccggccttctcagatccctggggagggtcacctgccaagcccagcaccaatggcacaacagccgggggattcgacacggagcccgacgagttctctgactttgaccgactccgcacggcactgccgacctccgggagcagcgcaggagagctggagctgctggcaggagaggtgccggcccgaagccctggggcgtttgacatgagtggggtcaggggatctctggctgaggctgtgggcagccccccacctgcagccacaccaactcccacgccccccacccggaagacgccggagtcattcctggggcccaatgcagccctcgtcgacctggactcgctggtgagccggccgggccccacgccgcctggagccaaggcctccaaccccttcctgccaggcggaggcccagccactggcccttccgtcaccaaccccttccagcccgcgcctcccgcgacgctcaccctgaaccagctccgtctcagtcctgtgcctcccgtccctggagcgccacccacgtacatctctccccttggcgggggccctggcctgccccccatgatgcccccgggccccccggcccccaacactaatcccttcctcctataatccagggcggaagggggcctggctccatccggctgccccattccggctccctgggagatcagtgttgtgagtgcatgtgaaatgggggatccccacccccagtgcccttcccctt

SEQ ID NO: 9697 - DNA, 4816 bp, Homo sapiens
atgttggctggtgtgtgggtgtcaaactgagccagacgcggcggtggcggcggctccgcgggctacggtcgctcccgcctctcgagcgctgccggtggccgcagcggcgcacccacgccggcccggaggagcagagtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctcgcctgaggcctcgctgtgcccccagcaccgcacaggggccccgctgggtcagagtgaggagctgcagccactgagccagcgccaccccttcctgccgcacctggggctggcctcccgcccaaatggcgactggtcccagccctgcctcacttgtgaccgcgcagcccgagccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgtacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggatccaagagtttggggattaggggtattagggcttttcagctccagcttcctgatgaaagggctgtctttacagccccaaccctcagaccctcgccttccaaggcaggcccctcagcctggcctgctctcaccacctcctccaaagcactgaggtcctggcagggctcctctgaggccttggacgaggacgtggagtcatcagtgttgcccttgcccctaacctcagcccgagggtctccaggatgttgcctggcccaggacttgggacagtggccttgtctttgtcctccccaccccccagccctagggacaccccaggcagtcctgggtgtggacacgatgaagcaccggctccataagacaccttttggggaagtggttgtgcatattttatttttctttgactcgtgtgagttcaaagtaaacaccaccaccgtggacaactcttgaattaaatccactagagcgagctttaaaactaatctgagcataacccccaacgtggctctatgcttgtgtacctttgcacatattttgtttagtacagtttcatatttgagtttgcagaattatctaatagtctttttttggctaatatttttataacgtggttcttatttaactgtctagttttgatagaatttaccaggtctggctgaatgaagatgttggcacgtgtcattttagtggtttaaatcctcttatttatggttttaactctaagaaaattttaaaaggaagagatgtttggatgacaaaaaaatgccttattgaaaaactaaagcaaattctttataggaagaaaatatgggaatttgattacacatagatgatgatgtttatttaaaaaaaaaacaacagcaacaaaaaatcctagcctccagttgccttttcctttctttagctcctgtttttggtgaattactaaactgattgactttcagcctttttggctagatcctgagaggctatttttcttacgaatataccaacatcctgaaagttaaagaaaaaaatctaatgtatgaatgtgactcaccaatttttatcaactaattccttttttttattaaaggcatgcagggattaacaggacttctgtttacaatggaaatctgaaatggaagaaacatctttaaccttgtgtgtctgtgatctcctctgtcttaatccacgctcaggctaaagatggggataatgtggaaatggcagttgtcccgagggcgtggggtggggggtgcttctgtgcccacgggtccctgggcaacagtccctaggctaagacaggggtggggggctaagggaccagggctggccctgatccacctacctgctaactccagatattatttttaagttggagacctaaaaataattctcttgtattttggagatgaagaaaaaagtcattcacctgggagggatttttaacaaacatgcactaatattacctccctcttccaaactcctactgtcctcacctcacccaccactgtaaaagtattacgtcgtgcattaaagaccagaaaagacttgcttttacccagggaggggacattcccccaatcctgtgtctgggcagcttgcctggtggatgtttctggccctttttccaccatgggaatttctcacctctagctctaagggcagctgaccacctgccagcccctctctggttccagaagattacccttcgcaccggcacaggagagatcttaaatggtctctgggctgctgggacatgcaggctctgagtggggactgcacccactcatgctgttcctgaggccgccctctccagtcccaggagccgtgtctagagttcctgaccagccaccttctgccagaactgcaggcctgcggctgggtcttaggctcccgctgccatttgggtaagccggtggctggtctcgtctgccgggggaagggtggggaggtgcaatgggatgggaggcaggatgcttgcccagaaaggtgctttccttcagacggtgcagggcctgggccagccttacaggtcagtagactagactcgactacttggggtcagtgattcttttgtaacgagtctttcatgatgtgactttgaggccccaacatgacagccactgggccaccgggacccaagaagacagccccctgccccatcttctggcacaggccatcccgagtgcatgtccctgttgcccactgcactgatcatgaagccaccggccactgccacgcatgttgcacctgtgccatcgtgctccctcctgatgggcaccgtggtggaggaagtcacccagctgtttctcagtcccagaggccggtggctggttttgaacttgtgttgactgttgatacttatttactgtataaatataatttatcatttgtaccatga

SEQ ID NO: 9698 - DNA, 4664 bp, Homo sapiens
gcgccccctcccggccgccatgttggctggtgtgtgggtgtcaaactgagccagacgcggcggtggcggcggctccgcgggctacggtcgctcccgcctctcgagcgctgccggtggccgcagcggcgcacccacgccggcccggaggagcagagtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgtacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggatccaagagtttggggattaggggtattagggcttttcagctccagcttcctgatgaaagggctgtctttacagccccaaccctcagaccctcgccttccaaggcaggcccctcagcctggcctgctctcaccacctcctccaaagcactgaggtcctggcagggctcctctgaggccttggacgaggacgtggagtcatcagtgttgcccttgcccctaacctcagcccgagggtctccaggatgttgcctggcccaggacttgggacagtggccttgtctttgtcctccccaccccccagccctagggacaccccaggcagtcctgggtgtggacacgatgaagcaccggctccataagacaccttttggggaagtggttgtgcatattttatttttctttgactcgtgtgagttcaaagtaaacaccaccaccgtggacaactcttgaattaaatccactagagcgagctttaaaactaatctgagcataacccccaacgtggctctatgcttgtgtacctttgcacatattttgtttagtacagtttcatatttgagtttgcagaattatctaatagtctttttttggctaatatttttataacgtggttcttatttaactgtctagttttgatagaatttaccaggtctggctgaatgaagatgttggcacgtgtcattttagtggtttaaatcctcttatttatggttttaactctaagaaaattttaaaaggaagagatgtttggatgacaaaaaaatgccttattgaaaaactaaagcaaattctttataggaagaaaatatgggaatttgattacacatagatgatgatgtttatttaaaaaaaaaacaacagcaacaaaaaatcctagcctccagttgccttttcctttctttagctcctgtttttggtgaattactaaactgattgactttcagcctttttggctagatcctgagaggctatttttcttacgaatataccaacatcctgaaagttaaagaaaaaaatctaatgtatgaatgtgactcaccaatttttatcaactaattccttttttttattaaaggcatgcagggattaacaggacttctgtttacaatggaaatctgaaatggaagaaacatctttaaccttgtgtgtctgtgatctcctctgtcttaatccacgctcaggctaaagatggggataatgtggaaatggcagttgtcccgagggcgtggggtggggggtgcttctgtgcccacgggtccctgggcaacagtccctaggctaagacaggggtggggggctaagggaccagggctggccctgatccacctacctgctaactccagatattatttttaagttggagacctaaaaataattctcttgtattttggagatgaagaaaaaagtcattcacctgggagggatttttaacaaacatgcactaatattacctccctcttccaaactcctactgtcctcacctcacccaccactgtaaaagtattacgtcgtgcattaaagaccagaaaagacttgcttttacccagggaggggacattcccccaatcctgtgtctgggcagcttgcctggtggatgtttctggccctttttccaccatgggaatttctcacctctagctctaagggcagctgaccacctgccagcccctctctggttccagaagattacccttcgcaccggcacaggagagatcttaaatggtctctgggctgctgggacatgcaggctctgagtggggactgcacccactcatgctgttcctgaggccgccctctccagtcccaggagccgtgtctagagttcctgaccagccaccttctgccagaactgcaggcctgcggctgggtcttaggctcccgctgccatttgggtaagccggtggctggtctcgtctgccgggggaagggtggggaggtgcaatgggatgggaggcaggatgcttgcccagaaaggtgctttccttcagacggtgcagggcctgggccagccttacaggtcagtagactagactcgactacttggggtcagtgattcttttgtaacgagtctttcatgatgtgactttgaggccccaacatgacagccactgggccaccgggacccaagaagacagccccctgccccatcttctggcacaggccatcccgagtgcatgtccctgttgcccactgcactgatcatgaagccaccggccactgccacgcatgttgcacctgtgccatcgtgctccctcctgatgggcaccgtggtggaggaagtcacccagctgtttctcagtcccagaggccggtggctggttttgaacttgtgttgactgttgatacttatttactgtataaatataatttatcatttgtaccatga

SEQ ID NO: 9699 - DNA, 2216 bp, Homo sapiens
atgttggctggtgtgtgggtgtcaaactgagccagacgcggcggtggcggcggctccgcgggctacggtcgctcccgcctctcgagcgctgccggtggccgcagcggcgcacccacgccggcccggaggagcagagccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgtacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggatccaagagtttggggattaggggtattagggcttttcagctccagcttcctgatgaaagggctgtctttacagccccaaccctcagaccctcgccttccaaggcaggcccctcagcctggcctgctctcaccacctcctccaaagcactgaggtcctggcagggctcctctgaggccttggacgaggacgtggagtcatcagtgttgcccttgcccctaacctcagcccgagggtctccaggatgttgcctggcccaggacttgggacagtggccttgtctttgtcctccccaccccccagccctagggacaccccaggcagtcctgggtgtggacacgatgaagcaccggctccataagacaccttttggggaagtggttgtgcatattttatttttctttgactcgtgtgagttcaaagtaaacaccaccaccgtggacaactcttgaattaaatccactagagcgagctttaaaactaatctgagcataacccccaacgtggctctatgcttgtgtacctttgcacatattttgtttagtacagtttcatatttgagtttgcagaattatctaatagtctttttttggctaatatttttataacgtggttcttatttaactgtctagttttgatagaatttaccaggtctggctgaatgaagatgttggcacgtgtcattttagtggtttaaatcctcttatttatggttttaactctaagaaaattttaaaaggaagagatgtttggatgacaaaaaaatgccttattgaaaaactaaagcaaattctttataggaagaaaatatgggaatttgattacacatagatgatgatgtttattt

SEQ ID NO: 9700 - DNA, 2862 bp, Homo sapiens
atggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgtacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggatccaagagtttggggattaggggtattagggcttttcagctccagcttcctgatgaaagggctgtctttacagccccaaccctcagaccctcgccttccaaggcaggcccctcagcctggcctgctctcaccacctcctccaaagcactgaggtcctggcagggctcctctgaggccttggacgaggacgtggagtcatcagtgttgcccttgcccctaacctcagcccgagggtctccaggatgttgcctggcccaggacttgggacagtggccttgtctttgtcctccccaccccccagccctagggacaccccaggcagtcctgggtgtggacacgatgaagcaccggctccataagacaccttttggggaagtggttgtgcatattttatttttctttgactcgtgtgagttcaaagtaaacaccaccaccgtggacaactcttgaattaaatccactagagcgagctttaaaactaatctgagcataacccccaacgtggctctatgcttgtgtacctttgcacatattttgtttagtacagtttcatatttgagtttgcagaattatctaatagtctttttttggctaatatttttataacgtggttcttatttaactgtctagttttgatagaatttaccaggtctggctgaatgaagatgttggcacgtgtcattttagtggtttaaatcctcttatttatggttttaactctaagaaaattttaaaaggaagagatgtttggatgacaaaaaaatgccttattgaaaaactaaagcaaattctttataggaagaaaatatgggaatttgattacacatagatgatgatgtttatttaaaaaaaaaacaacagcaac

SEQ ID NO: 9701 - DNA, 2863 bp, Homo sapiens
gctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctcgcctgaggcctcgctgtgcccccagcaccgcacaggggccccgctgggtcagagtgaggagctgcagccactgagccagcgccaccccttcctgccgcacctggggctggcctcccgcccaaatggcgactggtcccagccctgcctcacttgtgaccgcgcagcccgagccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgtacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacaggcatgcagggattaacaggacttctgtttacaatggaaatctgaaatggaagaaacatctttaaccttgtgtgtctgtgatctcctctgtcttaatccacgctcaggctaaagatggggataatgtggaaatggcagttgtcccgagggcgtggggtggggggtgcttctgtgcccacgggtccctgggcaacagtccctaggctaagacaggggtggggggctaagggaccagggctggccctgatccacctacctgctaactccagatattatttttaagttggagacctaaaaataattctcttgtattttggagatgaagaaaaaagtcattcacctgggagggatttttaacaaacatgcactaatattacctccctcttccaaactcctactgtcctcacctcacccaccactgtaaaagtattacgtcgtgcattaaagaccagaaaagacttgcttttacccagggaggggacattcccccaatcctgtgtctgggcagcttgcctggtggatgtttctggccctttttccaccatgggaatttctcacctctagctctaagggcagctgaccacctgccagcccctctctggttccagaagattacccttcgcaccggcacaggagagatcttaaatggtctctgggctgctgggacatgcaggctctgagtggggactgcacccactcatgctgttcctgaggccgccctctccagtcccaggagccgtgtctagagttcctgaccagccaccttctgccagaactgcaggcctgcggctgggtcttaggctcccgctgccatttgggtaagccggtggctggtctcgtctgccgggggaagggtggggaggtgcaatgggatgggaggcaggatgcttgcccagaaaggtgctttccttcagacggtgcagggcctgggccagccttacaggtcagtagactagactcgactacttggggtcagtgattcttttgtaacgagtctttcatgatgtgactttgaggccccaacatgacagccactgggccaccgggacccaagaagacagccccctgccccatcttctggcacaggccatcccgagtgcatgtccctgttgcccactgcactgatcatgaagccaccggccactgccacgcatgttgcacctgtgccatcgtgctccctcctgatgggcaccgtggtggaggaagtcacccagctgtttctcagtcccagaggccggtggctggttttgaacttgtgttgactgttgatacttatttactgtataaatataatttatcatttgtaccatga

SEQ ID NO: 9702 - DNA, 3196 bp, Homo sapiens
atgttggctggtgtgtgggtgtcaaactgagccagacgcggcggtggcggcggctccgcgggctacggtcgctcccgcctctcgagcgctgccggtggccgcagcggcgcacccacgccggcccggaggagcagagtgttcatttctgtgtcgggcacagtgctaagtgctgggtgctcactggtgatgaggcagatgaaggttaccaaacttgtggacaggagcctcatatcagagacgtggacctcactgtagcctggtcatggcttccagcttttcgaatctgaggctccaaaggaggaaatgaccattcagggatcttactccagcttgattacggagactgaaccttcatagggtgcgcacttaccaaggacaggaaggtttctctgtttgaagggctttaaacttataacaaagaaaataaaaatgacgacttcgtctatcagacggcagatgaaaaacatcgtgaacaattactcagaggcagaaatcaaagtccgggaagccacctccaatgacccgtggggcccgtccagttctctgatgaccgagattgccgacctgacctacaacgtggtggccttctcggagatcatgagcatggtgtggaagcggctgaatgaccatggcaagaactggcggcatgtgtacaaggcgctgaccctgctggactacctcatcaagacaggctccgaacgtgtggcccagcagtgccgggagaacatcttcgccatccagaccctgaaggacttccagtacattgaccgagatggcaaggaccagggcatcaatgtgcgtgagaagtcaaagcaactggtggctctcctcaaggacgaggaacggttgaaggctgagagggcccaggctctcaaaaccaaagagcgcatggcccaggttgccactggcatgggcagcaaccagatcacctttgggcgaggctccagccagcccaacctctccaccagccactcggagcaggagtatggcaaggccgggggctccccggcctcctaccatggctccacctccccgcgagtgtcctccgagctggagcaagcccggccccagactagtggagaagaggagcttcagctgcagctggcacttgccatgagcagagaagtggctgagcaggaagaacgcctcaggcggggtgatgacctcagattacagatggccctggaagaaagccgaagggacacagttaaaattccaaaaaagaaagagcatggctctctcccacagcagactacgctgttggatttaatggatgctctccccagctcgggccccgcggcccagaaagcagagccctggggcccgtcagcctccactaaccagaccaacccctggggcgggccagcggctcctgcgagtacttcagacccctggccatcgtttggtaccaagccagctgcctccattgacccatggggggtgcccactggagccaccgtacaatctgtccccaagaactcggacccctgggcagcttcacagcagcctgcctccagtgctgggaaaagagcttctgacgcgtggggcgcagtctccaccaccaagcccgtgtctgtctctgggtcctttgagctcttcagtaatctgaatggtacaattaaagatgacttttctgaatttgacaaccttcggacttcaaaaaaaacagccgaatctgtgacctctctgccatcccaaaacaatggaactaccagccctgacccctttgagtctcaacccctgactgtcgcctcaagcaagcccagcagtgcccggaaaacacctgagtccttcctgggccccaacgcggccctggtgaacctggactcactggtgaccaggcctgccccaccagcccagtccctcaaccctttcctggcaccaggcatgcagggattaacaggacttctgtttacaatggaaatctgaaatggaagaaacatctttaaccttgtgtgtctgtgatctcctctgtcttaatccacgctcaggctaaagatggggataatgtggaaatggcagttgtcccgagggcgtggggtggggggtgcttctgtgcccacgggtccctgggcaacagtccctaggctaagacaggggtggggggctaagggaccagggctggccctgatccacctacctgctaactccagatattatttttaagttggagacctaaaaataattctcttgtattttggagatgaagaaaaaagtcattcacctgggagggatttttaacaaacatgcactaatattacctccctcttccaaactcctactgtcctcacctcacccaccactgtaaaagtattacgtcgtgcattaaagaccagaaaagacttgcttttacccagggaggggacattcccccaatcctgtgtctgggcagcttgcctggtggatgtttctggccctttttccaccatgggaatttctcacctctagctctaagggcagctgaccacctgccagcccctctctggttccagaagattacccttcgcaccggcacaggagagatcttaaatggtctctgggctgctgggacatgcaggctctgagtggggactgcacccactcatgctgttcctgaggccgccctctccagtcccaggagccgtgtctagagttcctgaccagccaccttctgccagaactgcaggcctgcggctgggtcttaggctcccgctgccatttgggtaagccggtggctggtctcgtctgccgggggaagggtggggaggtgcaatgggatgggaggcaggatgcttgcccagaaaggtgctttccttcagacggtgcagggcctgggccagccttacaggtcagtagactagactcgactacttggggtcagtgattcttttgtaacgagtctttcatgatgtgactttgaggccccaacatgacagccactgggccaccgggacccaagaagacagccccctgccccatcttctggcacaggccatcccgagtgcatgtccctgttgcccactgcactgatcatgaagccaccggccactgccacgcatgttgcacctgtgccatcgtgctccctcctgatgggcaccgtggtggaggaagtcacccagctgtttctcagtcccagaggccggtggctggttttgaacttgtgttgactgttgatacttatttactgtataaatataatttatcatttgtaccatga

SEQ ID NO: 9703 - DNA, 4071 bp, Homo sapiens
aaagcagaggggatcaggtcgccagcactggctccagatgtgcacttcctgggggcggccaacaggcaggccccccacctctcaatgcaccacttgcctggccagcaggaaggggttaacctgccctgcacttcctcctgtgtcctgttactgctgaggcagacctgccgggccagctgagcaactttcctcggagtgctgcctggcgctggctaggaggcaaacgcacgcgggaagagctgctacccattccagggaccctgccgctgcccctctgaggggtctgcacctcctgggagcaggtgggtctctgggacgagggtccatggtggatggctctggagacgctcccgaggctgtgccgtcccgctgctgcacaggtcggagggtcaccgcagaggctactcgggctggggctggggccgagggagcccgcactggagccccatgtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggatgaggagcggctgcggcaggagcgaacccacgccctcaagaccaaggagcgcatggcactggagggcatcggcattggcagtgggcagctgggcttcagccgccgctacggcgaggactacagccgctcccggggctccccgtcctcctacaactcctcctcttcgtcaccccgctatacctccgacctggagcaggcccggcctcagacgtcaggggaagaggaactgcagctgcagctggccctcgccatgagccgtgaggaggcagagaagcctgtccccccagcctcccacagggacgaggacctgcagctgcagctggctctgcgcctgagccggcaggagcacgagaaggaggtgaggtcctggcagggtgatggctcccccatggccaatggtgcaggggccgtggtccaccatcagcgggacagagagcctgagagagaagagagaaaggaggaggagaagctaaaaaccagccagtcctccatcctggacttggctgacatcttcgtacctgccctggccccgccctccacacactgctctgctgacccatgggacatcccaggttttaggccgaacacagaggccagtggatcctcctgggggccttctgcagacccctggtctccgatcccctcaggaaccgtcctgtcccgaagccagccctgggatctgactcccatgctctcctcctctgagccctggggcaggaccccagtgctgcctgctgggccccccaccacagacccctgggccctgaactctccccaccacaaactccccagcactggggctgacccttggggagcctccctggagacctccgacacacctggtggtgcctcgacctttgacccatttgccaaacctccagaatccacagagaccaaggaggggctggagcaggccctgccctctgggaagcccagcagccctgtggagctggacctgtttggagaccccagccccagttccaagcaaaatggcacgaaggagccagatgccctggacctgggcatactaggggaagcactaacccagccaagcaaagaggcccgagcttgccggactcccgagtccttcctgggtccctcagcttcctccttggtcaaccttgactcgttggtcaaggcaccccaggttgcaaagacccggaaccccttcctgacaggtctcagcgctccgtcccccaccaacccgttcggcgcgggcgagccgggcaggccgacgctaaaccagatgcgcaccggctcgccggcgctgggcctggcaggcgggcctgtgggggcgcccctgggctccatgacctacagcgcctctctgcccctcccgctcagcagcgtgccagctggcttgaccctccccgcctcggttagcgtcttcccgcaggccggagccttcgcaccgcagccgctgctgcccacgccgagctcagccgggccgcggcccccgcccccgcagaccggcaccaaccccttcctctgagccccgccccgtcccataccggcctgcgcctgcgccggacgctccgcggccccgcctccggacccggggctgggcggggcgccggtgctagtggaacgccgagccagtggcggctggtatcccgcggcggctctggaagctggacgcggaccacggcccgggagctagaaactgaacgcccgcataataaagactggaaccctcgttctcagctctcaccaagtggactttttgcggggtgtggcggccgggtctcgaccacagcgtggatcaccggctgtttaggaaactgcagctgcacaacgtggggtgcaaaactgccccgcttcctttacagctcttctcaaccctcacctccatcccccgtcacccaggcaccttcgcttccagatgctgccaggctgtcactcaattcggtcatttcattcatttatcacacatgggcactggggttgggctaacagcaagagacaataggcctttgttcctatttattgggtactgcttacgtgctaagcagatcagtttatttaatgcttgcaacgactctctgaggtagaaaatattgttaattccgttcaggatcccggctacataatctgtggggctcaatacaaaataaaaatgtaggggctccttgttcaaaatcgtatgaagaatttcaaaacagggacaacagagcatgaaaccaagcgcaaagcccactgcagtgcgattgcacaggtatctcaccttgcagccggcactactcccatttttcaggcaaggaaaccgtggctcagagaggttgaatggcatgctcaaagtcacaaagctggcatggggcggggctggaactcaagagtcagacagtctggctccaaggcctggagatcccaggctgggccccagatttaattcagcaaatattgactgactgctgtggacaaagtgctgggctcaccttggagggatccaacctccaggagctcgagcgcagcagggtagacaagccaggggcacgtgatgcggctgtggcagaagccaagtgcaggagctcccaggctcctttgttttactgagtcaccttaaatgtaactctgccctctcccttgcttcgccaaggctagcgagaaactcagtcttagccacacaggaggaatcggaccccttctgggggtttatgtggagtctgggaaaccaagggtggggtgaggcctggtactcaatccaggaggggcccctatgaccaccctcgcctgtttttcttctcaatgctccctgatcactggaccactggacactgatgtgtcctcagtgcttggggtctggctctgcaggcagcctgcagccagcctccatccccctttcagggacaaatggccttccaccagagtcggtgagtggagaggcacaatgccactccccttcctgaggtgggggtaggggaagggagtcccacaatgcagttacaaacaggatggacaagaacacctgctcaggagtcagacttacagggttcaaagttctgctccaaggtttgaccctaacaagaatcacttagtaataagtggttatgctctgtgaccttgagtaaattacttaccctctcca

SEQ ID NO: 9704 - DNA, 2223 bp, Homo sapiens
gtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggatgaggagcggctgcggcaggagcgaacccacgccctcaagaccaaggagcgcatggcactggagggcatcggcattggcagtgggcagctgggcttcagccgccgctacggcgaggactacagccgctcccggggctccccgtcctcctacaactcctcctcttcgtcaccccgctatacctccgacctggagcaggcccggcctcagacgtcaggggaagaggaactgcagctgcagctggccctcgccatgagccgtgaggaggcagagaagcctgtccccccagcctcccacagggacgaggacctgcagctgcagctggctctgcgcctgagccggcaggagcacgagaaggaggtgaggtcctggcagggtgatggctcccccatggccaatggtgcaggggccgtggtccaccatcagcgggacagagagcctgagagagaagagagaaaggaggaggagaagctaaaaaccagccaggccccgcccacttctgagccgcggctgcctctcccctccacagtcctccatcctggacttggctgacatcttcgtacctgccctggccccgccctccacacactgctctgctgacccatgggacatcccaggttttaggccgaacacagaggccagtggatcctcctgggggccttctgcagacccctggtctccgatcccctcaggaaccgtcctgtcccgaagccagccctgggatctgactcccatgctctcctcctctgagccctggggcaggaccccagtgctgcctgctgggccccccaccacagacccctgggccctgaactctccccaccacaaactccccagcactggggctgacccttggggagcctccctggagacctccgacacacctggtggtgcctcgacctttgacccatttgccaaacctccagaatccacagagaccaaggaggggctggagcaggccctgccctctgggaagcccagcagccctgtggagctggacctgtttggagaccccagccccagttccaagcaaaatggcacgaaggagccagatgccctggacctgggcatactaggggaagcactaacccagccaagcaaagaggcccgagcttgccggactcccgagtccttcctgggtccctcagcttcctccttggtcaaccttgactcgttggtcaaggcaccccaggttgcaaagacccggaaccccttcctgacaggtctcagcgctccgtcccccaccaacccgttcggcgcgggcgagccgggcaggccgacgctaaaccagatgcgcaccggctcgccggcgctgggcctggcaggcgggcctgtgggggcgcccctgggctccatgacctacagcgcctctctgcccctcccgctcagcagcgtgccagctggcttgaccctccccgcctcggttagcgtcttcccgcaggccggagccttcgcaccgcagccgctgctgcccacgccgagctcagccgggacgcggaccacggcccgggagctagaaactgaacgcccgcataataaagactggaaccctcgttctcagctctcaccaagtggactttttgcggggtgtggcggccgggtctcgaccacagcgtggatcaccggctgtttaggaaactgcagctgcacaacgtggggtgcaaaactgccccgcttcctttacagct

SEQ ID NO: 9705 - DNA, 1862 bp, Homo sapiens
gtgctgcctggcgctggctaggaggcaaacgcacgcgggaagagctgctacccattccagggaccctgccgctgcccctctgaggggtctgcacctcctgggagcaggtgggtctctgggacgagggtccatggtggatggctctggagacgctcccgaggctgtgccgtcccgctgctgcacaggtcggagggtcaccgcagaggctactcgggctggggctggggccgagggagcccgcactggagccccatgtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggatgaggagcggctgcggcaggagcgaacccacgccctcaagaccaaggagcgcatggcactggagggcatcggcattggcagtgggcagctgggcttcagccgccgctacggcgaggactacagccgctcccggggctccccgtcctcctacaactcctcctcttcgtcaccccgctatacctccgacctggagcaggcccggcctcagacgtcaggggaagaggaactgcagctgcagctggccctcgccatgagccgtgaggaggcagagaaggaggtgaggtcctggcagggtgatggctcccccatggccaatggtgcaggggccgtggtccaccatcagcgggacagagagcctgagagagaagagagaaaggaggaggagaagctaaaaaccagccagtcctccatcctggacttggctgacatcttcgtacctgccctggccccgccctccacacactgctctgctgacccatgggacatcccaggttttaggccgaacacagaggccagtggatcctcctgggggccttctgcagacccctggtctccgatcccctcaggaaccgtcctgtcccgaagccagccctgggatctgactcccatgctctcctcctctgagccctggggcaggaccccagtgctgcctgctgggccccccaccacagacccctgggccctgaactctccccaccacaaactccccagcactggggctgacccttggggagcctccctggagacctccgacacacctggtggtgcctcgacctttgacccatttgccaaacctccagaatccacagagaccaaggaggggctggagcaggccctgccctctgggaagcccagcagccctgtggagctggacctgtttggagaccccagccccagttccaagcaaaatggcacgaaggagccagatgccctggacctgggcatactaggggaagcactaacccagccaagcaaagaggcccgagcttgccggactcccgagtccttcctgggtccctcagcttcctccttggtcaaccttgactcgttggtcaaggcaccccaggttgcaaagacccggaaccccttcctgacaggtctcagcgctccgccccgcctccggacccggggctgggcggggcgccggtgctag

SEQ ID NO: 9706 - DNA, 804 bp, Homo sapiens
gtgtcctgttactgctgaggcagacctgccgggccagctgagcaactttcctcggagtgctgcctggcgctggctaggaggcaaacgcacgcgggaagagctgctacccattccagggaccctgccgctgcccctctgaggggtctgcacctcctgggagcagccccatgtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggatgaggagcggctgcggcaggagcgaacccacgccctcaagaccaaggagcgcatggcactggagggcatcggcattggcagtgggcagctgggcttca

SEQ ID NO: 9707 - DNA, 603 bp, Homo sapiens
aactttcctcggagtgctgcctggcgctggctaggaggcaaacgcacgcgggaagagctgctacccattccagggaccctgccgctgcccctctgaggggtctgcacctcctgggagcaggtgggtctctgggacgagggtccatggtggatggctctggagacgctcccgaggctgtgccgtcccgctgctgcacaggtcggagggtcaccgcagaggctactcgggctggggctggggccgagggagcccgcactggagggtctcgctctgttgcccagtggcctgaccatggctcactgcagcctccaactactggcctcaagtgatcctcttgccttggcctcctgaagtcctggaattacaggcgtgagccactgcaccgggcccatttaatactctgagccccacctttcccatctgtggatggagccccatgtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaa

SEQ ID NO: 9708 - DNA, 810 bp, Homo sapiens
agcaagggggagggcaggagttaaacaagttgtggccgtggcattcccacagaaggcccacgacccgctggaaggaaagagatagcagacaaaagggtctcgctctgttgcccagtggcctgaccatggctcactgcagcctccaactactggcctcaagtgatcctcttgccttggcctcctgaagtcctggaattacaggcgtgagccactgcaccgggcccatttaatactctgagccccacctttcccatctgtggatggagccccatgtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggat

SEQ ID NO: 9709 - DNA, 580 bp, Homo sapiens
aactttcctcggagtgctgcctggcgctggctaggaggcaaacgcacgcgggaagagctgctacccattccagggaccctgccgctgcccctctgaggggtctgcacctcctgggagcagggtctcgctctgttgcccagtggcctgaccatggctcactgcagcctccaactactggcctcaagtgatcctcttgccttggcctcctgaagtcctggaattacaggcgtgagccactgcaccgggcccatttaatactctgagccccacctttcccatctgtggatggagccccatgtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtg

SEQ ID NO: 9710 - DNA, 560 bp, Homo sapiens
actagcaagggggagggcaggagttaaacaagttgtggccgtggcattcccacagaaggcccacgacccgctggaaggaaagagatagcagacaaaagccccatgtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggactt

SEQ ID NO: 9711 - DNA, 2449 bp, Homo sapiens
gtgctgcctggcgctggctaggaggcaaacgcacgcgggaagagctgctacccattccagggaccctgccgctgcccctctgaggggtctgcacctcctgggagcaggtgggtctctgggacgagggtccatggtggatggctctggagacgctcccgaggctgtgccgtcccgctgctgcacaggtcggagggtcaccgcagaggctactcgggctggggctggggccgagggagcccgcactggagccccatgtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggatgaggagcggctgcggcaggagcgaacccacgccctcaagaccaaggagcgcatggcactggagggcatcggcattggcagtgggcagctgggcttcagccgccgctacggcgaggactacagccgctcccggggctccccgtcctcctacaactcctcctcttcgtcaccccgctatacctccgacctggagcaggcccggcctcagacgtcaggggaagaggaactgcagctgcagctggccctcgccatgagccgtgaggaggcagagaaggaggtgaggtcctggcagggtgatggctcccccatggccaatggtgcaggggccgtggtccaccatcagcgggacagagagcctgagagagaagagagaaaggaggaggagaagctaaaaaccagccagtcctccatcctggacttggctgacatcttcgtacctgccctggccccgccctccacacactgctctgctgacccatgggacatcccaggttttaggccgaacacagaggccagtggatcctcctgggggccttctgcagacccctggtctccgatcccctcaggaaccgtcctgtcccgaagccagccctgggatctgactcccatgctctcctcctctgagccctggggcaggaccccagtgctgcctgctgggccccccaccacagacccctgggccctgaactctccccaccacaaactccccagcactggggctgacccttggggagcctccctggagacctccgacacacctggtggtgcctcgacctttgacccatttgccaaacctccagaatccacagagaccaaggaggggctggagcaggccctgccctctgggaagcccagcagccctgtggagctggacctgtttggagaccccagccccagttccaagcaaaatggcacgaaggagccagatgccctggacctgggcatactaggggaagcactaacccagccaagcaaagaggcccgagcttgccggactcccgagtccttcctgggtccctcagcttcctccttggtcaaccttgactcgttggtcaaggcaccccaggttgcaaagacccggaaccccttcctgacaggtctcagcgctccgtcccccaccaacccgttcggcgcgggcgagccgggcaggccgacgctaaaccagatgcgcaccggctcgccggcgctgggcctggcaggcgggcctgtgggggcgcccctgggctccatgacctacagcgcctctctgcccctcccgctcagcagcgtgccagctggcttgaccctccccgcctcggttagcgtcttcccgcaggccggagccttcgcaccgcagccgctgctgcccacgccgagctcagccgggccgcggcccccgcccccgcagaccggcaccaaccccttcctctgagccccgccccgtcccataccggcctgcgcctgcgccggacgctccgcggccccgcctccggacccggggctgggcggggcgccggtgctagtggaacgccgagccagtggcggctggtatcccgcggcggctctggaagctggacgcggaccacggcccgggagctagaaactgaacgcccgcataataaagactggaaccctcgttctcagctctcaccaagtggactttttgcggggtgtggcggccgggtctcgaccacagcgtggatcaccggctgtttaggaaactgcagctgcacaacgtggggtgcaaaactgccccgcttc

SEQ ID NO: 9712 - DNA, 1675 bp, Homo sapiens
gtgctgcctggcgctggctaggaggcaaacgcacgcgggaagagctgctacccattccagggaccctgccgctgcccctctgaggggtctgcacctcctgggagcagccccatgtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggatgaggagcggctgcggcaggagcgaacccacgccctcaagaccaaggagcgcatggcactggagggcatcggcattggcagtgggcagctgggcttcagccgccgctacggcgaggactacagccgctcccggggctccccgtcctcctacaactcctcctcttcgtcaccccgctatacctccgacctggagcaggcccggcctcagacgtcaggggaagaggaactgcagctgcagctggccctcgccatgagccgtgaggaggcagagaaggaggtgaggtcctggcagggtgatggctcccccatggccaatggtgcaggggccgtggtccaccatcagcgggacagagagcctgagagagaagagagaaaggaggaggagaagctaaaaaccagccaggttttaggccgaacacagaggccagtggatcctcctgggggccttctgcagacccctggtctccgatcccctcaggaaccgtcctgtcccgaagccagccctgggatctgactcccatgctctcctcctctgagccctggggcaggaccccagtgctgcctgctgggccccccaccacagacccctgggccctgaactctccccaccacaaactccccagcactggggctgacccttggggagcctccctggagacctccgacacacctggtggtgcctcgacctttgacccatttgccaaacctccagaatccacagagaccaaggaggggctggagcaggccctgccctctgggaagcccagcagccctgtggagctggacctgtttggagaccccagccccagttccaagcaaaatggcacgaaggagccagatgccctggacctgggcatactaggggaagcactaacccagccaagcaaagaggcccgagcttgccggactcccgagtccttcctgggtccctcagcttcctccttggtcaaccttgactcgttggtcaaggcaccccaggttgcaaagacccggaaccccttcctgacaggtctcagcgctccgtcccccaccaacccgttcggcgcgggcgagccgggcaggccgacgctaaaccagatgcgcaccggctcgccggcgctgggcctg

SEQ ID NO: 9713 - DNA, 1128 bp, Homo sapiens
ccgcagccatgaccccgcagcttctcctggcccttgtcctctgggccagctgcccgccctgcagtggaaggaaagggcccccagcagctctgacactgccccgggtgcaatgccgagcctctcggtacccgatcgccgtggattgctcctggaccctgccgcctgctccaaactccaccagccccgtgtccttcattgccacgtacaggctcggcatggctgcccggggccacagctggccctgcctgcagcagacgccaacgtccaccagctgcaccatcacggatgtccagctgttctccatggctccctacgtgctcaatgtcaccgccgtccacccctggggctccagcagcagcttcgtgcctttcataacagagcacatcatcaagcccgaccctccagaaggcgtgcgcctaagccccctcgctgagcgccagctacaggtgcagtgggagcctcccgggtcctggcccttcccagagatcttctcactgaagtactggatccgttacaagcgtcagggagctgcgcgcttccaccgggtggggcccattgaagccacgtccttcatcctcagggctgtgcggccccgagccaggtactacgtccaagtggcggctcaggacctcacagactacggggaactgagtgactggagtctccccgccactgccacaatgagcctgggcaagtagcaagggcttcccgctgcctccagacagcacctgggtcctcgccaccctaagccccgggacacctgttggagggcggatgggatctgcctagcctgggctggagtccttgctttgctgctgctgagctgccgggcaacctcagatgaccgacttttccctttgagcctcagtttctctagctgagaaatggagatgtactactctctcctttacctttacctttaccacagtgcagggctgactgaactgtcactgtgagatattttttattgtttaattagaaaagaattgttgttgggctgggcgcagtggatcgcacctgtaatcccagtcactgggaagccgacgtgggagggtagcttgaggccaggagctcgaaaccagtccgggccacacagcaagaccccatctctaaaaaattaatataaat

SEQ ID NO: 9714 - DNA, 962 bp, Homo sapiens
gttggcggcggttggctcggcgcgggagtcggctgcacgtgcgggcgggggcgatgcgtcactgatcggtgaggcgcggccgaggggtcggctttcctcgcgagcctgcggctgggcttcttctcagaggaacgagaatgaatatgactcaagcccgggttctggtggctgcagtggtggggttggtggctgtcctgctctacgcctccatccacaagattgaggagggccatctggctgtgtactacaggggaggagctttactaactagccccagtggaccaggctatcatatcatgttgcctttcattactacgttcagatctgtgcagacaacactacaaactgatgaagttaaaaatgtgccttgtggaacaagtggtggggtcatgatctatattgaccgaatagaagtggttaatatgttggctccttatgcagtgtttgatatcgtgaggaactatactgcagattatgacaagaccttaatcttcaataaaatccaccatgagctgaaccagttctgcagtgcccacacacttcaggaagtttacattgaattgtttgatcaaatagatgaaaacctgaagcaagctctgcagaaagacttaaacctcatggccccaggtctcactatacaggctgtgcgtgttacaaaacccaaaatcccagaagccataagaagaaattttgagttaatggaggctgagaagacaaaactccttatagctgcacagaaacaaaaggttgtggaaaaagaagctgagacagagaggaaaaaggcagttatagaagcagagaagattgcacaagtggcaaaaattcggtttcagcagaaagtgatggaaaaagaaactgaaaagcgcatttctgaaatcgaagatgctgcattcctggcccgagagaaagcgaaagcagatgctgaatattatgctgcacacaaatatgccacctcaaacaag

SEQ ID NO: 9715 - DNA, 1045 bp, Homo sapiens
gttggcggcggttggctcggcgcgggagtcggctgcacgtgcgggcgggggcgatgcgtcactgatcggaggaacgagaatgaatatgactcaagcccgggttctggtggctgcagtggtggggttggtggctgtcctgctctacgcctccatccacaagattgaggagggccatctggctgtgtactacagacaacactacaaactgatgaagttaaaaatgtgccttgtggaacaagtggtggggtcatgatctatattgaccgaatagaagtggttaatatgttggctccttatgcagtgtttgatatcgtgaggaactatactgcagattatgacaagaccttaatcttcaataaaatccaccatgagctgaaccagttctgcagtgcccacacacttcaggaagtttacattgaattgtttgatcaaatagatgaaaacctgaagcaagctctgcagaaagacttaaacctcatggccccaggtctcactatacaggctgtgcgtgttacaaaacccaaaatcccagaagccataagaagaaattttgagttaatggaggctgagaagacaaaactccttatagctgcacagaaacaaaaggttgtggaaaaagaagctgagacagagaggaaaaaggcagttatagaagcagagaagattgcacaagtggcaaaaattcggtttcagcagaaagtgatggaaaaagaaactgaaaagcgcatttctgaaatcgaagatgctgcattcctggcccgagagaaagcgaaagcagatgctgaatattatgctgcacacaaatatgccacctcaaacaagcacaagttgaccccggaatatctggagctcaaaaagtaccaggccattgcttctaacagtaagatctattttggcagcaacatccctaacatgttctccatatcaagatgtggcccaaggggttaagtgggaacaatcattatacggactcttcagatttacagagaacttacacttcatctgttccacctctcctgcgatagtcctgggtgctccactgatt

SEQ ID NO: 9716 - DNA, 1453 bp, Homo sapiens
ggctgttggcggcggttggctcggcgcgggagtcggctgcacgtgcgggcgggggcgatgcgtcactgatcggaggaacgagaatgaatatgactcaagcccgggttctggtggctgcagtggtggggttggtggctgtcctgctctacgcctccatccacaagattgaggagggccatctggctgtgtactacaggggaggagctttactaactagccccagtggaccaggctatcatatcatgttgcctttcattactacgttcagatctgtgcagacaacactacaaactgatgaagttaaaaatgtgccttgtggaacaagtggtggggtcatgatctatattgaccgaatagaagtggttaatatgttggctccttatgcagtgtttgatatcgtgaggaactatactgcagattatgacaagaccttaatcttcaataaaatccaccatgagctgaaccagttctgcagtgcccacacacttcaggaagtttacattgaattgtttgatcaaatagatgaaaacctgaagcaagctctgcagaaagacttaaacctcatggccccaggtctcactatacaggctgtgcgtgttacaaaacccaaaatcccagaagccataagaagaaattttgagttaatggaggctgagaagacaaaactccttatagctgcacagaaacaaaaggttgtggaaaaagaagctgagacagagaggaaaaaggcagttatagaagcagagaagattgcacaagtggcaaaaattcggtttcagcagaaagtgatggaaaaagaaactgaaaagcgcatttctgaaatcgaagatgctgcattcctggcccgagagaaagcgaaagcagatgctgaatattatgctgcacacaaatatgccacctcaaacaagcacaagttgaccccggaatatctggagctcaaaaagtaccaggccattgcttctaacagtaagatctattttggcagcaacatccctaacatgttcgtggactcctcatgtgctttgaaatattcagatattaggactggaagagaaagctcactcccctctaaggaggctcttgaaccctctggagagaacgtcatccaaaacaaagagagcacaggttgatgcaagaggtggaaatgttctccatatcaagatgtggcccaaggggttaagtgggaacaatcattatacggactcttcagatttacagagaacttacacttcatctgttccacctctcctgcgatagtcctgggtgctccactgattggaggatagagccagctgtctgacacacaaatggtcttttcagccacagtcttatcaagtatcctatatgtattcctttctaaactgctactcatgaatgaggaaagtctgatgctaagatactgcctgcactggaatgttaaacactaaatatataacaagctgtgttttcctaa

SEQ ID NO: 9717 - DNA, 5792 bp, Homo sapiens
attataataaaacagttgaatatggcttaggaaaatatgaaggttccatgaagtggaattaagagcatagaataactgtactttccttaggaataataggacttatggtaaaggtagtattgggcaacttctttaagagtgttttcctctgagatgtcctatcaccactatctacatctaaaaaacatgctcgattcttgccctataaactgatgtcacagccccaccatccccatttttgctagtggtatcattttcctagtcaaccaaattttttagtcatcacatatcactgttcgtcatctattataataggcagtctctctcttgtttccctggttttagaagattttagtaataaacatttattgggtacctgttacttggagggtattaagctagatggcaagatctgaaacaacataggcagtatagtaaaagtgcttatctgggagtctgaacattacaagccatccaagcattgcaattattgttaaggattattttcaatggtcatgcattttctaatattttaataattggttaaagatttgttatagcgtgggggccgctgctggtgtgtggctggggttatgtcagggcagcctgatctatataatttgggcagatggtgtgagtcagaacagactattatagtgggatccccaaacttgcttttgatgcatgagttggaccactattttttggtgggtaacaacttttcagaggggaatggcagttgtgaattgtatacatttcattctttaagcaatattatgaaaaacttcagagaatgtctacagaaaacagggtatggagcaagttattttccattctttttgctttttggaagttaaaatagctaagctctgcaaatatcatttatttggaacagataaggtcccagacattcctagataataaaaatcaaatgaatgatacaggtaagtgtatttattgaagggtgtgggtagagtggtctgggaagtcttgctttaatgaagacggattgattctatttacctcttcttacttccactactaagtaaccctgggcctgcagtttcctaaccacttgacttccttgccaacagtctgtctccactttcagccgttttatagattcattggccctaaagcactgctttcccatacttccctacccaagagggcaggggtccccaagccctgggccgcggaccggaaccagacagtggcctgttaggaaccaagccggatagcaggaggtgagcggcgggcgagtgagcattatcgccttgagctctgcctgctgtcagattagcgagtggcatcagattctcataggcacgcgaaccctattgtgaactgcacatgtgaggtttgccggctccctgtgagaatctaatgcctgatgatctgaagtggaacagtttcatccccaacccacacacacccccaccccgtccgctgggttagaggactttacaaccctagtccaccttgtccagttatagttccacctctagcctttcaaggcttaaaccattaatgtccttaatttctcttgtattcatctatctcccaactatacctttttccttcccttttttatttttggcaatatgtgcccatggttttttaatttaaaacgaacagaatatgtagtgacgcctaccatagcactccttcccatcacacaagccttcaaggaaactgaagtacttactttggtctccctggaggattccctccgcctcccgccccatgtgcttagcaattctgttcctgtagtctggatggccttcataaagccctcactggaccagcattctggcacataataggaacacttaaaaaacgagagaatgatgccgttatatctaatatcttcctcttctgaactttcacagcactttatttgcaacaagtttagttgctcctgaagggcaggatctctgccggaagcaagtgcgtgccacacagtggggctccgcatacactgcaaaaggacaaataaaccgaacagctaccgtttgagagtgagcgagtgggttctctgcacaagaacaaaccaaccagtcccttgtccgaaagggcgtctccttttctctgcttcgctgctcactccagactgcgggctgtcctcttccgaagcagttaaccagcagtgtacagaaagcgacttgcctccaaaggagcctgcgcggcccgcggctaggagaattttgtcccatgcgctccccgtctcactagccgcgggccggggctacgccgtgtgcgtccccgcgcagccgcagtgctgggcgagtgggcggggccggctgttggcggcggttggctcggcgcgggagtcggctgcacgtgcgggcgggggcgatgcgtcactgatcggtgaggcgcggccgaggggtcggctttcctcgcgagcctgcggctgggcttcttctcagttagtgccttccacccgggagcgacccttgggagagggagtttcaggaagctcaccgagcaggggcggcccactggcctccgggggcggaggagttggcaaggggtcagcgggctcagccagaagggaagaatgaggggacaggggtactggactccccggctcagcctgcgagagagcgccaagtttccggagggagagggtagaaactggagggggtggacctgtcactcacgggactgagggtccttttctcccgctcccaggaggaacgagaatgaatatgactcaagcccgggttctggtggctgcagtggtggggttggtggctgtcctgctctacgcctccatccacaagattgaggagggccatctggctgtgtactacaggggaggagctttactaactagccccagtggaccaggctatcatatcatgttgcctttcattactacgttcagatctgtgcagacaacactacaaactgatgaagttaaaaatgtgccttgtggaacaagtggtggggtcatgatctatattgaccgaatagaagtggttaatatgttggctccttatgcagtgtttgatatcgtgaggaactatactgcagattatgacaagaccttaatcttcaataaaatccaccatgagctgaaccagttctgcagtgcccacacacttcaggaagtttacattgaattgtttgatcaaatagatgaaaacctgaagcaagctctgcagaaagacttaaacctcatggccccaggtctcactatacaggctgtgcgtgttacaaaacccaaaatcccagaagccataagaagaaattttgagttaatggaggctgagaagacaaaactccttatagctgcacagaaacaaaaggttgtggaaaaagaagctgagacagagaggaaaaaggcagttatagaagcagagaagattgcacaagtggcaaaaattcggtttcagcagaaagtgatggaaaaagaaactgaaaagcgcatttctgaaatcgaagatgctgcattcctggcccgagagaaagcgaaagcagatgctgaatattatgctgcacacaaatatgccacctcaaacaagcacaagttgaccccggaatatctggagctcaaaaagtaccaggccattgcttctaacagtaagatctattttggcagcaacatccctaacatgttcgtggactcctcatgtgctttgaaatattcagatattaggactggaagagaaagctcactcccctctaaggaggctcttgaaccctctggagagaacgtcatccaaaacaaagagagcacaggttgatgcaagaggtggaaatgttctccatatcaagatgtggcccaaggggttaagtgggaacaatcattatacggactcttcagatttacagagaacttacacttcatctgttccacctctcctgcgatagtcctgggtgctccactgattggaggatagagccagctgtctgacacacaaatggtcttttcagccacagtcttatcaagtatcctatatgtattcctttctaaactgctactcatgaatgaggaaagtctgatgctaagatactgcctgcactggaatgttaaacactaaatatataacaagctgtgttttcctaagctgagatctgttgaataatgtttacattcgtcccccggggaaatgtatgctcagccaccattcaagagatgactgagaaggagatggtaagttcaagaagactgattgcacctgggacccaggccctttctttgggatccagtcccagccttcatccatgtgattaagatccaggccgctgaagttccccaggaaatgatcttccacttgagcaaccttttacttgatacgatttgcacctttctgttttcctgcagtcagggtggtggcctgcagggacctgagctttgctacccaaccagattcctcatagagattcctaatcactagtttcttgtattcataaactcagagatacagagggcttggtttgaagttggggtgagatgaaacctttgctctgagccaaagctctggggccttgcattccctgcattgggttgatgactgtcagcatcactgccgcaggccatgcttgactaaggtacctggttttagccacagccacctccttgtatgttacctttcagctctggccaagagtgggacagggttttaaccacaaataggagcagcatgcaattcctagtgacttgctgcacagtattgtatcataattacaggaagtttttatttttaaaactggatctggggtatattcatttgccccatcacctctgtctaaaggcccaagtcctagggctgccatggtcacaagcacactgatgctccttaagattgtttatctggagcccacatagtgtggaacaaaaagtcacctagaaagcatccttggtcatcattgtctccttcccacctggcccagagatgcttaaatccaagttgtttctccagctgtcacctcccccaggagatcaggattccactgacgtcctgggcagccagtgaatttaattttccatgagaaacaacagagttaacctgtggcattaggagacctacttcatgtggaccctttttttccttcagtttaacttttctggagcagtgtgctgcgtagttcggcctgagtttgtgcagcttgttaagacaactcttgtgtacgctatgttgaagctcaacaaaaaagtcatgggaccacttctagaaatctttcagctgtcaggcctgtcagtctcatgacagtttgttggttgtgccaaacactttatttgggaaaggaaagcccagatttgaatgggtctttcccctgggccttatcctatagaggcatttgtaatatggagaaaataatttttcatttttgctcatttaattctataaattctctttataaatgaattttgtgttctttagttctccttaaaagaacttttgaattataaaaataaaatctttacctgtcgaattgttgctgcagatgattgttgtggaaaatctggatcattgacctctgtgctttcattcctagagatgttttatagttacatgagcaaaagctgttgccccaaagtgatggccctggaggcggggctgaggaacagggaaatgccgctgtgaagtcttaaagcacttctgcttaaactcccatgtgtgaggagtgtgcctccctgtgccctctcagctctgaggctggccgtctttcggggtgttccttttggcaaatatacactgtaatcttgagtctaaatttatatgttgaaatgctaccttttttaaaataagaaactaaataaaattattttactatca

SEQ ID NO: 9718 - DNA, 6073 bp, Homo sapiens
ttttcttgctcgtgggctcggacgagtacggagcgcctgcagggacagcctggataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcagaccacactccagacagatgaggtgaagaatgtaccttgtgggactagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttgatcagattgatgaaaatctcaaactggctttgcaacaggacctgacctccatggcccctgggctggtcattcaagctgtgcgggtaacaaagcccaacataccagaggcaatccgcagaaactacgagttgatggaaagtgagaagacaaagcttctcattgccgcccagaaacagaaggtggtggaaaaggaagcagagacagagcggaagaaggcgctcattgaggcagaaaaagtggcccaggtggctgagatcacctacgggcagaaggtgatggagaaggagactgagaagaagatttcagaaattgaagatgctgcatttctggcccgggagaaggcaaaggcagatgctgagtgctacactgctatgaaaatagccgaagccaataagctgaagctaacccctgaatatctgcagctgatgaagtacaaggccattgcttccaacagcaagatttactttggcaaagacattcctaacatgttcatggactctgcgggcagtgtgagcaagcagtttgaggggctagctgacaagctaagctttggcttagaagatgaacccttggagacggccactaaggagaattgaaaaaaacttgatatgactgcaaatgatacttaagcagatctttattttttaagatgaatcagaatgttcctccctccccgactaccttctctgactgtcttccagttactgtggtgaaaaagaagaaatgaacttaaatccactccctttctagggaaaggagggtggggactgatgatggggggttttatttcaggtaagcagtttatatgacttccaataagatttgtaaatcatgggcttgacctttgacctctagacactaattttatcctttgaggctggcttaattagggatgctgtcattaaggagagggagaaatgtagagtgttacctccaactcatttgatttcccttacttgggaaaatgcagtccagtgttctcacctctgcctccaaggtaggagatgtctgtgggtgaggctcagcaactgagcaaatatgtgcctgtgagtttgccagtagagctgtgaagaaacagctgcagagaacatttgaccttcctggcattcttgtctgcatgtgtgtgagttattttagaggtgtgctttcttgagccctcataaggaagtactggtgctaggttttgcaagattttgtatacactttgctccttgccctagggctcagagtggtggtttctgactacatttctagagtcagagcttgatcaccacaactcaattatttcggcatcttttcacctatgctgtgatttgttttttttttttcttctcaaaaattctgttcattggttccactcagcatcaagaagacagggacaaacaactcaagtgtcttaacagctgctggagtgggatccttgttatctcttagccactgcaggacctgcctgacaggttatgtgtgcacctcgagatgaagtgtctttctattattgtagagattctgtagtgaagaggtctgacaccatgtgtggaggaggaggaacgatcagtcaagagatgtcctggtcttaatgcctgtggcttgtgctgggagtgggtctgacttagtgataaaaggactctattcactaagtagcctgtgtttttaaatccagggctgcaggcagcaacgcaagtcaggctgaacattcagtctccagagacagctgtgtggagcaaatcagagttcatgcccaagtccccaggttggaatggctgtgccaaaatccattcaaagggttttctttttcattactaggtcagaacattttgagtcaccttgggagattcaggatggggagagcaaatttgaacaaaaggtttttcttatatcctgagattgaggggtagggggtgtccaacctgtatagcccatgggttgtgtctagaattaagtggagggcagctatctggagttaacttgcaagcatattggtgccctccatgaccacctctggcttaggacttggccctgttatgagctgacccccaccccccaccccccaccccccccccccgccaactcctatacccatcttccctaggtgaatctgtgaatggtcctttctggcagcaatccctgccttctttttgggcccatgcccagacttctggtttaaggaatggtcccagagcttgggccagcttgctcagaagttttgggagcattgagcctgcctagaaagatacagtgttagctccccttacttcaaagttgcccttctctgttctgactcctgggacttctggtcctgggcacactttttgcaggcaacaaaatgtgcctgggagtgatggattttaatgtgctccagagtcctttcagaaggtggtcatttcccttggccgggcgcggtggctcacacctgtaatcccagcactttgggaggccaaggcaggcggatcacctgaggttaggagttcgagaccaccctggccaacatgcgaaaccccatctctacgaaaaatagaaatattagccgggcatggtgtcaggcacctgtaatcccagctacttgggaggctgaggcaggagaattgcttgaactcgggaggcagaggttgcagtgagccaagatcatgccatcccactctagcttgggcaatagagcaaggctccgtctcaagaaaagaaggtcatttcccaagactagcatagggagtatccatttaaaatacattcatcttcctcccatttccgtgctattaatcacttgttagagcaacatgacatgcccagcatcccacttcccgaaaatgtctactccttctactctgagctcttgttgcctagacctcagaaaacaccaattcaccacagtagaaccgggagcagggatagctcagcttctctgaatagcacactttgctcaggtcttaacttgagggcctctccggtactaacatcctgcgatagcttgtcccatgagcacagaagagcctcagtagagtcaagtcctgctgcagctgccccaccccaagtttctatcatttcctctttaaacaaaaaatatgttatcctacacattagtgtcaatccaatggttgtctcttatctgtctaaatagcaaaatcatgaaaatcagctgttttatttgcataggacaactaacctgtctgtgtaactttgtttttattttaactcttactagaaaatctaatcttaaaacatttgaattctaaacatgtaaaatgtgacagcctgcaattttgtagacagtgaagtaatggctgctatttataaatggaacatctatcaaaataagtaactgtttataaaattcagtttttgtagggttttccaaggaaaaatcaccttggttgaatgtttctcactcattaaactttgcagaagtgattcatattcagtactgtttttaatcactttttaaaatataaggaccgaatgcaaggaaaccaaagtttattaataatttttatataactaaaataaaatagatgtggagggatctgtgatcatataaaaagggagggttactgaaagaattttagcaatatattgattcaggaaaaggagctgttttataaatgatcattcactgttcctatggttctatgtatctttcaaaccgatacctttactatttaaagagcgtaaatagtgaaagtaagatggtcatacttactgactttatctatttaagtttgatggagataaactatatcttggctagtggctactgtgtctgtgaatgtaaccagtacttctttaagctctattcagtagggttccagccactgcttttttgttgtttctagccactgttttttttttcttgtttccttataaaacaggtaataaccaatcattttgtgtttgtatttccattcctttttatttctgcctttgtgtagactgatgattaagtaggcaaactacttctactttcaaagagccccaagggcttaatgaccccatttgtaactgagaaatgattcttgttttagtaatcattctataaatgatactgctggattgattgccgtgggttgatagctggaggaattgttttggacaatactaacatgtgaatttatgtcttagttttatttgcagtcttgctaagtaaaatgagtctttgtatctacttttttattaaagtgaaatttagcaatagttaatattaggtgacataaataaaacatcccagactagtgagttaagtacaagatctctctaaaaataaacagatgaaaatctatccccattatcgatacagaatttgtgaacgtggcataattcttggtaggtgctatagagatttatcattttaaacagttcacacaccactgcaattctgctccaaaggacaaagatattttcaagtgaaccaaaattcattttgatatcagttcagtggacgaactcccagtctttactctggaaagctgcccagcttagggttgccagataaaacataagatacctagttaaatatgaatttcaacaatgtacaatttttagtctaagtactatgtgtcctaaacactgcatgagacatactcataccaaagtatttgttgcttatgtgtaattcatatttaactgggtatcctgtatttttacttgttaagtccggcaaccctagcccaggctttctcaggttttttttaacagggatcccaagctttttctattggtttgagagcctgctacacaaataatatgatcttaacaattgaatagttatgttaagagtgtagttactgcagttagactgccaaagttcaaatcactgctctactacttcttaggtgtgtggtcttgaataagttttttgacctctctaagcctcagtttcttcattaataaaatgagttgcatggcttatatgaaataatgcatacgaagggctttcacactgtaccttgcatgtatgtattcaaaaacttcaatctggagaaacgggctaaaaaacatacagctattaaatgggagccactaagtagaaagccaaacacgtgaaaaaaaatggaataagattacaaatgggatagcacatagaagaagggaatgacattgcaatgcagcaaacacagtattgaggatacatacctctacaaaaatgttgtgtagaaaataacctggtttaaagaaagaaaagaaaagaaaagaagccaggcacggtggttcacacctgtaatcctagcactttgggaggctgaggtgggtggatcacctgaggtcgggagttcaagaccagcctgaccaacatagagaaaccccatctcgactaaaaatagaaaattaaccgggcatggtggtgcatgcctgaaatcccagctacttgggaggctaaggcaggagaatcacttgaacctgggaggtagaggatgcagtgagccaaaatcacgccactgcactccagcctgggcaacaagagcaaaactctatctccaaaaaaaagaaaagaatctgatttggccctgttgagaggaactgtccagttctggtctccaattttaaaaatgaaaaaaatttgaagaagctagaaagaaaatgttaaaaccaaaaag

SEQ ID NO: 9719 - DNA, 1473 bp, Homo sapiens
ggaagtcgcgtgctgaggggtgtgacggttttcttgctcgtgggctcggacgagtacggagcgcctgcagggacagcctggataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcagaccacactccagacagatgaggtgaagaatgtaccttgtgggactagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttggactggaaaatgatttttcccaggaatcttcataaaagggaccctgagcaagaacatttttcatagcagacaggaggactcatccacatcgccagcaatcataattaagcaaaccgccttttgcaccatttaagatttaggaaatcatccaaattacttttaatgtttctgcagtagaaaatgaatctaaattcattttatagggtttgtagtcttttatctgttttggattcactgtgcttttaagaaaaagttggtaaatttgccgttgatttttctttttaacctcaaactaatagaattttataaaatattaattttctctagccattgtcttaggacttgtgacattacatgaacatttcaaagcactgaaaaaagacaaaggatccctaatgtccctgaagaggaaattaaaatacaaagttgtttttcattagcaaacttcttactttcttacagctaaacttggtagcttagtgaagtacagctgcttgtatggaggagctggggaaatatatttgctttgaaacttttttatttttacatctcagtcttgctagcaagcactacttggcttagaatctgtcatatccataaaggaggagctcatgtctctagtcctggcccttcaactcagaaggttcttctatactttccttctctcaggactcttatagcccagactttaaacatgaagctgcataattttcatcacttcttactctgccgcatcctctttgcccatgttattaaagtattatctaatactttgaagtttacctgaagaacctctttgtgtgtacttagtaatacaactttttttcctgtcccaacaccttttaatacagttgaatggataaaaacatggatacaaacacatggatatagttatcactgaagcagtgtgacataaaataatacctatgtatacaacactcctctgtaaatagc

SEQ ID NO: 9720 - DNA, 1718 bp, Homo sapiens
tactggtaggaaaggttcagtgacagcacattcgtgttcacaggaagacaaggctgtgttctgaaccctacccagctggcacgggttctcccttgagcaacggctgtatccggagccagtgcttcctcagtgcggtgggggctctaattttacagttaaagaaaggggaacgttgactgagaacgaggaggaagcgagttgtagatctagccttgtgttcacacgacaccaggctggatatgagtcactcgcagggagctcagcttggtgaggtcctctcgctgttgtggccttttctcctgcacgttggaccacacacattttcccgtgtcttttccctaggataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcagaccacactccagacagatgaggtgaagaatgtaccttgtgggactagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttgatcagattgatgaaaatctcaaactggctttgcaacaggacctgacctccatggcccctgggctggtcattcaagctgtgcgggtaacaaagcccaacataccagaggcaatccgcagaaactacgagttgatggaaagtgagaagacaaagcttctcattgccgcccagaaacagaaggtggtggaaaaggaagcagagacagagcggaagaaggcgctcattgaggcagaaaaagtggcccaggtggctgagatcacctacgggcagaaggtgatggagaaggagactgagaagaagatttcagaaattgaagatgctgcatttctggcccgggagaaggcaaaggcagatgctgagtgctacactgctatgaaaatagccgaagccaataagctgaagctaacccctgaatatctgcagctgatgaagtacaaggccattgcttccaacagcaagatttactttggcaaagacattcctaacatgttcatggactctgcgggcagtgtgagcaagcagtttgaggggctagctgacaagctaagctttggcttagaagatgaacccttggagacggccactaaggagaattgaaaaaaacttgatatgactgcaaatgatacttaagcagatctttattttttaagatgaatcagaatgttcctccctccccgactaccttctctgactgtcttccagttactgtggtgaaaaagaagaaatgaacttaaatccactccctttctagggaaaggagggtggggactgatgatggggggttttatttcaggtaagcagtttatatgacttccaataagatttgtaaatcatgggcttgacctttgacctctagacactaattttatcctttgaggctggcttaattagggatgctgtcattaaggagagggagaaatgtagagtgttacctccaa

SEQ ID NO: 9721 - DNA, 2347 bp, Homo sapiens
ggttttcttgctcgtgggctcggacgagtacggagcgcctgcagggacagcctggataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcagaccacactccagacagatgaggtgaagaatgtaccttgtgggactagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttggtaagaaagtctctcctgagcatgccgtgcttaagcagggttcctggaaccccgcgtctctccactgcctaaagcctggctgcctgcagggtgtgatggtcacttatggacaggaaatgttaaagaatcttgtgctcaggagctggtcacaaaggagttcatggagaatgctgatagctatgcaacaagatccttagagggctggagctttgggcacagggaccatagtggagtagagtattcacttctggcctcaatcagaggctggagtggaaatgtgttcccactgttcctaaactatcattctataatgaagacaaggtccattctagaagaaccttagagattgtccagaccagcatcctcattttaagctgagggtactgtgacccaaagcaagaaagtcacagagccagatgccaattagtagtggggctgaaacaggagccttcctctcctggctcttcagcattcttctcaccatgcaacactgaatggagggcccccaggaatgggtgatgaaaaagacatgattcatagttaattctagaagtgagatgagaaccatagctccttccagttctcagaacctttgtgattattatttttttactctgtacctgtagcaacgaatagaaaaacactttaaacaaaaagattccacgtgcctaagtagatatgttttgtcctttttacctttttcaaagtaaaggcaacctgacttagcagcaaaggaaggacacagttgggtaactgttataacttgtttgcagtcaagtattctgtttaaactcactgccagaaattctctaatagccaatgccaaaagtaaatgaatttttaaccaatagtataactgttcttgacactaggactggaaaatgatttttcccaggaatcttcataaaagggaccctgagcaagaacatttttcatagcagacaggaggactcatccacatcgccagcaatcataattaagcaaaccgccttttgcaccatttaagatttaggaaatcatccaaattacttttaatgtttctgcagtagaaaatgaatctaaattcattttatagggtttgtagtcttttatctgttttggattcactgtgcttttaagaaaaagttggtaaatttgccgttgatttttctttttaacctcaaactaatagaattttataaaatattaattttctctagccattgtcttaggacttgtgacattacatgaacatttcaaagcactgaaaaaagacaaaggatccctaatgtccctgaagaggaaattaaaatacaaagttgtttttcattagcaaacttcttactttcttacagctaaacttggtagcttagtgaagtacagctgcttgtatggaggagctggggaaatatatttgctttgaaacttttttatttttacatctcagtcttgctagcaagcactacttggcttagaatctgtcatatccataaaggaggagctcatgtctctagtcctggcccttcaactcagaaggttcttctatactttccttctctcaggactcttatagcccagactttaaacatgaagctgcataattttcatcacttcttactctgccgcatcctctttgcccatgttattaaagtattatctaatactttgaagtttacctgaagaacctctttgtgtgtacttagtaatacaactttttttcctgtcccaacaccttttaatacagttgaatggataaaaacatggatacaaacacatggatatagttatcactgaagcagtgtgacataaaataatacctatgtatacaacactcctctgtaaatagcaaatgtaaagtaaaagatacacaacaga

SEQ ID NO: 9722 - DNA, 1742 bp, Homo sapiens
ggcccccgccccttcgtgcgcgcgctgggcctagctgccgctcagggtcggggctgacccgtcactttcgggaacctcagtcccagcagcttctctccctcagccggcccgctcctggagagagacagaaacccttttctgtcgcgtcctctccttgcgagccgcagggggaccgagcggaggctattggagccgcagccccagaccagggcgcttgaccctctctcggaacggggcggggaaggggcgcgagtgacctcggggagggaagggcactggcaggaaaggacgcaactgcagatcggtagccggaggccgccacggataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcagaccacactccagacagatgaggtgaagaatgtaccttgtgggactagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttggactggaaaatgatttttcccaggaatcttcataaaagggaccctgagcaagaacatttttcatagcagacaggaggactcatccacatcgccagcaatcataattaagcaaaccgccttttgcaccatttaagatttaggaaatcatccaaattacttttaatgtttctgcagtagaaaatgaatctaaattcattttatagggtttgtagtcttttatctgttttggattcactgtgcttttaagaaaaagttggtaaatttgccgttgatttttctttttaacctcaaactaatagaattttataaaatattaattttctctagccattgtcttaggacttgtgacattacatgaacatttcaaagcactgaaaaaagacaaaggatccctaatgtccctgaagaggaaattaaaatacaaagttgtttttcattagcaaacttcttactttcttacagctaaacttggtagcttagtgaagtacagctgcttgtatggaggagctggggaaatatatttgctttgaaacttttttatttttacatctcagtcttgctagcaagcactacttggcttagaatctgtcatatccataaaggaggagctcatgtctctagtcctggcccttcaactcagaaggttcttctatactttccttctctcaggactcttatagcccagactttaaacatgaagctgcataattttcatcacttcttactctgccgcatcctctttgcccatgttattaaagtattatctaatactttgaagtttacctgaagaacctctttgtgtgtacttagtaatacaactttttttcctgtcccaacaccttttaatacagttgaatggataaaaacatggatacaaacacatggatatagttatcactgaagcagtgtgacataaaataatacctatgtatacaacactcctctgtaaatagcaaatgtaaagtaaaagatacacaaca

SEQ ID NO: 9723 - DNA, 8647 bp, Homo sapiens
ggacggagctggatcctgcttctcgccaaggcaggaagtgagtttcgcactgcaattccgggcggtgtcacgagtgaaaagttttgtttttttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagaagcatccccagacatccagttcaggagatccttgtcaagatggtatattcatttcaggacagcagaactactcatcagccacacttagtcacaaagatgttcctccagacagcttgatgaaaatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaagacaagtctcggtgttccctttattcttagtttgtttttaaatattaattttggcattctaaaatagctaacatttcttttattgatttcagattttcacaggcacattctacttttaatcagaaatatatttaataagtataattgtgaagttttcaactactttaccttgaaccacatataccaattataattttggaaaaggaattaagcctcacggaacaatggatcttcagcaaaccttaacttcattgtctgcacattacattgaagtattataaatgcaacagatgttatatgcactggcattttatcctactctagttagttaaaattttatagtattcttgcaacacataaagttgcgtaagaaactttaccaagaggagtattatagccaagttttctttgaaagtattggaaaactaaaattaaatgacaaggactttgaattagaattttgctgtaataaagtttcaaaatttgaataaaataattaaattttttgaggaagtggagaagacatttttagtttatatattgttgagtaaattgtagttaaggcctatacccataactaactttagtaagtattatatagcaattcatcaaaaccacaactgtcttttagtgattttgtctttaagagtaatttcttactctaaccagtaaaaaaataatactgatcagagtaatttatacggcatacaatagttgatacaatctaaagatttatgctaattaaggaattatcacttcatctgaatcaatgaaattctaaaattccctacatatttattttgtaaatattcttctgacctctttggactggatatgaagatatatatatatacacttaattcttttaaacacaaaacttgccataagcagaaccaaacttttaagtattaatttgctgcacttaaaaaatcccattagcagctatgtaatatttttatcaaccaacatttattcattccaaatttttgtatatatctagatgaagtaacacatagaggatagataacaaactaatgatgtttaaactggtttatttacaaaattcggggttagagaaattctcatgaaaaatatacaatttttttttagcattaaaaccctgtatatctaggtgtggaagaagtgtagtttatctcaaattattattatttacttctaaagggaggcattaagatgggaaatgtttctctgatggagattgacgtgtgaaatctatttggaagggtatttttttcactcagtctgttgcattcttacagccttctgttttaatgttcagtgaataggtttcttatgaaatggacattgaaataaaaattatgattcaagagcattaattgatgaacaagtgaacaagatgcctctttaaaaaaaaaaaagaaaaagtaatctagacaggcagccaactcagacctttgggtattcctttgtttctaaataaggaccttcagaaaaagttgaccatattctacctaaagctgctaattctttacagaattcataagcccaggggatagtaagtagtcatttagttttggaaagttcttaagagaatgctatcttctacagtctcatgaagcagtttttcaagattagaatctgtggtcagctataacgtacagtcctaatatccaaccacctgagaagctcatcctaagctgagaaagcctaaaatgttagagaatgtttagagaaaacacctgaaattttttttaagagaacaacctaggttttattgtagagaacaatcaaaatactcctgaacctttctatagaatctttaggagagaggctgacaaaaagaatccttctgttacaactttcttttctaatgtaacaaccagggacaatggtgatctgtcacgcatctgcccatctagcttctcaatcggcccacggttttatttcaggataaaatttgagaaactagtatcactggggaaggaagaaacctaagctgtaaaattatgcttttcccctcaagggattcaataaagcttatttttcatgaaaacaa

SEQ ID NO: 9724 - DNA, 6691 bp, Homo sapiens
cggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaagacaagtctcggtgttccctttattcttagtttgtttttaaatattaattttggcattctaaaatagctaacatttcttttattgatttcagattttcacaggcacattctacttttaatcagaaatatatttaataagtataattgtgaagttttcaactactttaccttgaaccacatataccaattataattttggaaaaggaattaagcctcacggaacaatggatcttcagcaaaccttaacttcattgtctgcacattacattgaagtattataaatgcaacagatgttatatgcactggcattttatcctactctagttagttaaaattttatagtattcttgcaacacataaagttgcgtaagaaactttaccaagaggagtattatagccaagttttctttgaaagtattggaaaactaaaattaaatgacaaggactttgaattagaattttgctgtaataaagtttcaaaatttgaataaaataattaaattttttgagg

SEQ ID NO: 9725 - DNA, 6805 bp, Homo sapiens
cggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaagacaagtctcggtgttccctttattcttagtttgtttttaaatattaattttggcattctaaaatagctaacatttcttttattgatttcagattttcacaggcacattctacttttaatcagaaatatatttaataagtataattgtgaagttttcaactactttaccttgaaccacatataccaattataattttggaaaaggaattaagcctcacggaacaatggatcttcagcaaaccttaacttcattgtctgcacattacattgaagtattataaatgcaacagatgttatatgcactggcattttatcctactctagttagttaaaattttatagtattcttgcaacacataaagttgcgtaagaaactttaccaagaggagtattatagccaagttttctttgaaagtattggaaaactaaaattaaatgacaaggactttgaattagaattttgctgtaataaagtttcaaaatttgaataaaataattaaattttttgagg

SEQ ID NO: 9726 - DNA, 4701 bp, Homo sapiens
aaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatgctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttatt

SEQ ID NO: 9727 - DNA, 6865 bp, Homo sapiens
cggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaagacaagtctcggtgttccctttattcttagtttgtttttaaatattaattttggcattctaaaatagctaacatttcttttattgatttcagattttcacaggcacattctacttttaatcagaaatatatttaataagtataattgtgaagttttcaactactttaccttgaaccacatataccaattataattttggaaaaggaattaagcctcacggaacaatggatcttcagcaaaccttaacttcattgtctgcacattacattgaagtattataaatgcaacagatgttatatgcactggcattttatcctactctagttagttaaaattttatagtattcttgcaacacataaagttgcgtaagaaactttaccaagaggagtattatagccaagttttctttgaaagtattggaaaactaaaattaaatgacaaggactttgaattagaattttgctgtaataaagtttcaaaatttgaataaaataattaaattttttgagg

SEQ ID NO: 9728 - DNA, 6410 bp, Homo sapiens
ttttgtttttttttttttcggcggagatcctcgttggggctgggaaactcctgcaaaactcgagaccaggaagccagcccgcaccccaacccccaccaaagccacctactcttcttctgtgggaggccagtccacatccgctctcacccgagagagatattcagctggatccaaagtgactgatgaagggaaggaaatcatgtcaagcgaagccttgaaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttattcaactggtattaatgtttttctcctgaaactactttttttgatgtgggcaagagatttgaagtgttggcttttgctatgtgcatattgaattgaagagtgagtaggtgaaggtggtgctggtgggttcactttccaaggccagactaaaacagttattttctataaaaatctggaagcaaagaatggggatggggagagctacgtggtagtatgtttttattaggagaataatgcaataaaatatgtaatgtcttttttataaagcaaaaaagacaataattgcatttatgagctcggcaggatctgttcttgtcatagccattgactatacatttgctactggtgattcagtttttaattttttagtcacaggaaatttttaactctactgtagatgcatgtccatgcattttctgtgttatggaaatccactgatttttttttttttttcaaatggtggtacttgcaatctgttttataattagtgctccatttaaatctaatttataatttttattttaagcagcaaatgaaacaaaaatggccagttttaagattgtgttgcctgtaacacaaaatgttacgaaggtttaggaaagcctctttgatttttgtttggccttgcattgccttggtaaagtaaaaggaaacagtacacttggagctaggaaaccaaagcaagctttgtgaaactggcacagtgatagagaattgctgtggagagttatagagcaaagggatgggtccttgaggcctgccagtgtgtaaaggtgttcaaataaagggctgtttctacaggtaacattaaatgtgaactcaacacttccagagtctttaaagggtttctatgtgtatcagtgtaatagtgttttaccaccaactgcctttctttgttcctagttactgtaacaaatatttgatgatagaggtttattaattttgtttatccagaccattaattttatttgtttttgttctatgtaatcaaataaaatttgagtaacatgtaatggtaaggattaatgcatggttatttggaccagaaaaaagtgccatagaagaccaataactgtttagttgaggctagtctggaacctttcattagagcaatatttggttattgcacttcatttttatttactaagaaatgcaatttgggaatttttaatctgttatgctttgtttatcaaccttgattttaattaagacttttataagactagcttaaaacaccaaccaacattatttttgcaaaagtgagttggactcactttccattcttgctagtcagagtaagtaggcagcacttttaaaaatatgtgaactcaaatattgcacttctttcaagatgttatcaattggttattgtactgtatagttttaataattttgattgaaaccctttaacaactctttgtaaattttaactcattttagttgattttcagtactatttacataggaattgatttttatggatatagtagaagaaatgtgctgtattttgataaaattcacttattgtatgtgtgttgtaatctaaaaaaaaaaagaatgacaaacagcttctttaagacaa

SEQ ID NO: 9729 - DNA, 4374 bp, Homo sapiens
agaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaagatttattggaagatacttacaggggaaattaatattttgactatttttatatataaagaagaactcaaaaaattatgttcaaatttgtacattaatgaaataatggaacttgtggttagagggaaagaaccactgtacagaatataaaggagactgttgaattcataccatataaaacttgttaggtttttaaacatagcaatcaaggctacaaaaacaaacctgtgttgtttttgtatagattgtaggtttatttttggatttcatatacatgactgaactgtgtgcaaggcaatagttagccttgattttagcccagagacagatggcagagctatctctctcatagcttttatgcccttatttttatt

SEQ ID NO: 9730 - DNA, 4386 bp, Homo sapiens
aaaaagctgccctgagacggtgtcccgccgaaagaatgttggctcaattaagaaacatcagggagataaattcaacccagtgtgtctaaaaatgactacaaaacgaagtttgtttgtgcggttggtaccatgtcgctgtctacgaggggaagaggagactgtcactactcttgattattctcattgcagcttagaacaagttccgaaagagatttttacttttgaaaaaaccttggaggaactctatttagatgctaatcagattgaagagcttccaaagcaactttttaactgtcagtctttacacaaactgagtttgccagacaatgatttaacaacgttaccagcatccattgcaaaccttattaatctcagggaactggatgtcagcaagaatggaatacaggagtttccagaaaatataaaaaattgtaaagttttgacaattgtggaggccagtgtaaaccctatttccaagctccctgatggattttctcagctgttaaacctaacccagttgtatctgaatgatgcttttcttgagttcttgccagcaaattttggcagattaactaaactccaaatattagagcttagagaaaaccagttaaaaatgttgcctaaaactatgaatagactgacccagctggaaagactggatttgggaagtaacgaattcacggaagtgcctgaagtacttgagcaactaagtggattgaaagagttttggatggatgctaatagactgacttttattccagggtttattggtagtttgaaacagctcacatatttggatgtttctaaaaataatattgaaatggttgaagaaggaatttcaacatgtgaaaaccttcaagacctcctattatcaagcaattcacttcagcagcttcctgagactattggttcgttgaagaatataacaacgcttaaaatagatgaaaaccagttaatgtatctgccagactctataggagggttaatatcagtagaagaactggattgtagtttcaatgaagttgaagctttgccttcatctattgggcagcttactaacttaagaacttttgctgctgatcataattacttacagcagttgcccccagagattggaagctggaaaaatataactgtgctgtttctccattccaataaacttgagacacttccagaggaaatgggtgatatgcaaaaattaaaagtcattaatttaagtgataatagattaaagaatttaccctttagctttacaaagctacagcaattgacagctatgtggctctcagataatcagtccaaacccctgatacctcttcaaaaagaaactgattcagagacccagaaaatggtgcttaccaactacatgttccctcaacagccaaggactgaggatgttatgtttatatcagataatgaaagttttaacccttcattgtgggaggaacagaggaaacagcgggctcaagttgcatttgaatgtgatgaagacaaagatgaaagggaggcacctcccagggagggaaatttaaaaagatatccaacaccatacccagatgagcttaagaatatggtcaaaactgttcaaaccattgtacatagattaaaagatgaagagaccaatgaagactcaggaagagatttgaaaccacatgaagatcaacaagatataaataaagatgtgggtgtgaagacctcagaaagtactactacagtaaaaagcaaagttgatgaaagagaaaaatatatgataggaaactctgtacagaagatcagtgaacctgaagctgagattagtcctgggagtttaccagtgactgcaaatatgaaagcctctgagaacttgaagcatattgttaaccatgatgatgtttttgaggaatctgaagaactttcttctgatgaagagatgaaaatggcggagatgcgaccaccattaattgaaacctctattaaccagccaaaagtcgtagcacttagtaataacaaaaaagatgatacaaaggaaacagattctttatcagatgaagttacacacaatagcaatcagaataacagcaattgttcttctccatctcggatgtctgattcagtttctcttaatactgatagtagtcaagacacctcactctgctctccagtgaaacaaactcatattgatattaattccaaaatcaggcaagaagatgaaaattttaacagccttttacaaaatggagatattttaaacagttcaacagaggaaaagttcaaagctcatgataaaaaagattttaacttacctgaatatgatttgaatgttgaagagcgattagttctaattgagaaaagtgttgactcaacagccacagctgatgacactcacaaattagatcatatcaatatgaatcttaataaacttataactaatgatacatttcaaccagagatcatggaaagatcaaaaacacaggatattgtgcttggaacaagctttttaagcattaattctaaagaggaaactgagcacttggaaaatggaaacaagtatcctaatttggaatccgtaaataaggtaaatggacattctgaggaaacttcccagtctcctaataggactgaaccacatgacagtgattgttctgttgacttaggtatttccaaaagcactgaagatctctcccctcagaaaagtggtccagttggatctgttgtgaaatctcatagcataactaatatggagattggagggctaaaaatctatgatattcttagtgataatggacctcagcagccaagtacaaccgttaaaatcacatctgctgttgatggaaaaaatatagtcaggagcaagtctgccacactgttgtatgatcaaccattgcaggtatttactggttcttcctcatcttctgatttaatatcaggaacaaaggcaattttcaagtttgattcaaatcataatcccgaagagccaaatataataagaggccccacaagtggcccacaatctgcacctcaaatatatggtcctccacagtataatatccaatacagtagcagtgctgcagtcaaagacactttgtggcactccaaacaaaatccccaaatagaccatgccagttttcctcctcagctccttcctagatcagagagcacagaaaatcaaagttatgctaaacattctgccaatatgaatttctctaatcataacaatgttcgagctaatactgcataccatttacatcagagacttggcccagcaagacatggggaaatgtgggccatctcaccaaacgaccgacttattcctgcagtaactcgaagtacaatccagcgacaaagtagtgtgtcctccacagcctctgtaaatcttggtgatccaggctctacaaggcgggctcagattcctgaaggagattatttatcatacagagagttccactcagcgggaagaactcctccaatgatgccaggatcacagagacccctttctgcacgaacatacagcatagatggtccaaatgcatcaagacctcagagtgctcgaccctctattaatgaaataccagagagaactatgtcagttagtgatttcaattattcacggactagtccttcaaaaagaccaaatgcaagggttggttctgagcattctttattagatcctccaggaaaaagtaaagttcctcgtgactggagagaacaagtacttcgacatattgaagccaaaaagttagaaaagagcatgctgtcaaggtcctttaattccaattttactactgtaagcagttttcactgtggcagctctagggatctgcatggcagccagggcagtcttgccttgagtgttgcagacagaagaggttctggtgggcacatttttcgaatgcctttgagtaatggacagatgggccagcctctcaggcctcaggcaaattatagtcaaatacatcacccccctcaggcatctgtggcaaggcatccctctagagaacaactaattgattacttgatgctgaaagtggcccaccagcctccatatacacagccccattgttctcctagacaaggccatgaactggcaaaacaagagattcgagtgagggttgaaaaggatccagaacttggatttagcatatcaggtggtgtcgggggtagaggaaacccattcagacctgatgatgatggtatatttgtaacaagggtacaacctgaaggaccagcatcaaaattactgcagccaggtgataaaattattcaggctaatggctacagttttataaatattgaacatggacaagcagtgtccttgctaaaaactttccagaatacagttgaactcatcattgtacgagaagtttcctcataagcactgtggacaaaaaaagcggggaagacagcaag

SEQ ID NO: 9731 - DNA, 1281 bp, Homo sapiens
atgaaggaagaggaaggttttcctgaagatgaggcgactgaatcggaaactttaagtttggtaaaagagttggatgcctttccgaaggttcctgagagctatgtagagacttcagccagtggaggtacagtttctctaatagcatttacaactatggctttattaaccataatggaattctcagtatatcaagatacatggatgaagtatgaatacgaagtagacaaggatttttctagcaaattaagaattaatatagatattactgttgccatgaagtgtcaatatgttggagcggatgtattggatttagcagaaacaatggttgcatctgcagatggtttagtttatgaaccaacagtatttgatctttcaccacagcagaaagagtggcagaggatgctgcagctgattcagagtaggctacaagaagagcattcacttcaagatgtgatatttaaaagtgcttttaaaagtacatcaacagctcttccaccaagagaagatgattcatcacagtctccaaatgcatgcagaattcatggccatctatatgtcaataaagtagcagggaattttcacataacagtgggcaaggcaattccacatcctcgtggtcatgcacatttggcagcacttgtcaaccatgaatcttacaatttttctcatagaatagatcatttgtcttttggagagcttgttccagcaattattaatcctttagatggaactgaaaaaattgctatagatcacaaccagatgttccaatattttattacagttgtgccaacaaaactacatacatataaaatatcagcagacacccatcagttttctgtgacagaaagggaacgtatcattaaccatgctgcaggcagccatggagtctctgggatatttatgaaatatgatctcagttctcttatggtgacagttactgaggagcacatgccattctggcagttttttgtaagactctgtggtattgttggaggaatcttttcaacaacaggcatgttacatggaattggaaaatttatagttgaaataatttgctgtcgtttcagacttggatcctataaacctgtcaattctgttccttttgaggatggccacacagacaaccacttacctcttttagaaaataatacacattaacacctcccgattgaaggagaaaaactttttgcctgagacataaaacctttttttaataataaaatattgtgcaatatattcaaagaaaagaaaacacaaataagcagaaaacatacttatttt

SEQ ID NO: 9732 - DNA, 5014 bp, Homo sapiens
tctgtgaaacatggcggtaggctgggaccataacacaagcatgactatatgaaggaagaggaaggttttcctgaagatgaggcgactgaatcggaaaaaaactttaagtttggtaaaagagttggatgcctttccgaaggttcctgagagctatgtagagacttcagccagtggaggtacagtttctctaatagcatttacaactatggctttattaaccataatggaattctcagtatatcaagatacatggatgaagtatgaatacgaagtagacaaggatttttctagcaaattaagaattaatatagatattactgttgccatgaagtgtcaatatgttggagcggatgtattggatttagcagaaacaatggttgcatctgcagatggtttagtttatgaaccaacagtatttgatctttcaccacagcagaaagagtggcagaggatgctgcagctgattcagagtaggctacaagaagagcattcacttcaagatgtgatatttaaaagtgcttttaaaagtacatcaacagctcttccaccaagagaagatgattcatcacagtctccaaatgcatgcagaattcatggccatctatatgtcaataaagtagcagggaattttcacataacagtgggcaaggcaattccacatcctcgtggtcatgcacatttggcagcacttgtcaaccatgaatcttacaatttttctcatagaatagatcatttgtcttttggagagcttgttccagcaattattaatcctttagatggaactgaaaaaattgctatagatcacaaccagatgttccaatattttattacagttgtgccaacaaaactacatacatataaaatatcagcagacacccatcagttttctgtgacagaaagggaacgtatcattaaccatgctgcaggcagccatggagtctctgggatatttatgaaatatgatctcagttctcttatggtgacagttactgaggagcacatgccattctggcagttttttgtaagactctgtggtattgttggaggaatcttttcaacaacaggcatgttacatggaattggaaaatttatagttgaaataatttgctgtcgtttcagacttggatcctataaacctgtcaattctgttccttttgaggatggccacacagacaaccacttacctcttttagaaaataatacacattaacacctcccgattgaaggagaaaaactttttgcctgagacataaaacctttttttaataataaaatattgtgcaatatattcaaagaaaagaaaacacaaataagcagaaaacatacttattttaaaaaagaaaaaaaaggataaaaaaacccaaactgaaattctatatacgttgtgtctgttacaaatgtcgtagaagaaatcatgcagctaaacgatgaagaagcccaactggagtgttgctttgaagatgacgccttcttatattttcatagcaaatgggtggtatcaaaatcagacattgcttcttgctgataaaaagcctgaaggaaataagtgaaactacatctatgggaaaaaaaaaaacattgagaagtgcaaatgttcgcatccttttgtttttaaaagatatgatgtcagaataaaatgtggaaaacatacggaaaactagtctagactttaaagaattgtgatcaggtcacattgttaataaaaaaaaaaaacgggctagtccctatgttatagccatattaatgttaagccatattgacaagaccagttatccaataatttggtcttaaaaagtaactacttttctttgaactctggttattgacttatctaactgttgaagatagagtcttagaagactaaggtaaattctcacaggggcagatatgtaggtgttatgtaactagggtgtcattcacaaatggtatagtagaatcttatacacggaaaagaaagcacatttttttaaaaaagatgccaagttttttaatctaatcattatattattggtgtattttgggcaacatagggtgagttataaaaagatccgctactgatagtgaaaattaccggtttgtaaaacattaagagaaaaaataggatattttatacatgtggtgagtggagaacagggtaactttaaatgaaagtgtaaggcaaattgtaagcaccacaagatatatcagatttgagaggtgccatgttaaacattgtccattaaactataaaactgtattatgaagtatttgcattcagggtgtcctgaatatgattgattctgtattagattgtgttctaactttcttactatttaaggattggttctaaatcttcacattataaaagattaaaaacagtgagagggagctatcacacaggtactattaaaagctgtatttggaatatgtgtaccaatatcagttttccttttgtagtactgaatggcagtagaagaatcagcagccaatcctcaaagtttaaatcatttaaggaaatggggaaacaaaattccaggtaaataacaagactgaaaaactagatttaaaatagtggttttagaaaacaggatatcacaagtaacagtttttcaaatggatttttttaaagataaatttatgaaaacaggataaacaatataatggagagaaggagaaatagtgatgggtctgttttgcagtaaagtttatgcagaatgacgttttgcagaaaataacagaagcatcactttaaaaaatatatcattaagagccatgacgttaactgatgaaaataagtgatataacatactttgaaagatttttaaacagaaaattctgaatcgtgaatgagccttctctaggttttaattttttttcttcaaattatttccaacaaagtttggctataaactaacaccatctatccacaggaattttaataggaaaggattagaattgtagactgattgttggtcctttaagtatgcttggaagaaaattcaatcgagtttcaaggctttttctaaatgggagggagaacaatattgatttaggattattttctttcatttaggattagaacagttaagtgcctttaaaaaggactttaaaaattattttgatacttatatatgatttttaattgttttcgtattttccaaataccatattaaaattttaatgaaatttatctcctatgaaaggaatttctttaaagcaaaattctgctttgcctttgatttccattttaaaagttaaaggcttccatctgaaactcctcaaatagagtcagatttttggcaatggaagtattaaaattccgatcagccctttggacgatgaagtttacctgcatattaggatttgttaggagtttttggcctcaccaagtgattcttttctattgcagagagcactttactcacctacctgttatgcaactttccctatgcctggaggtgcctccagccaggataccctactttgttacccaattctcctttttgttttacaagagtattcataatatctatatgtttatattccagactacatatttaaaaatgagatctcaaattatatgaaatggatttttaaatactgtgtttgcatacattgacctataaagaagattaaatatttaggtgaataattccctgctgcagtatttgtacacttcagactacctcttaggaaaagcttaacttagtattgcaaaattccctttctctttttttttttaagagatggggtctcgcactgttgcccaggctgaagtgcagtggcatgattgtaactcactgcatcctcgaactcctgggttcaagcaatcctcctgcttccatctgctgagtaggtaggactacagccatgcaccaacaaacctggctaattctttttcatttatatagttagtatcttgctgtgttgttcaagctggactccaactcccggactcaagtaatcctcccaccttagtctcctgcattgctggaattataggcacgagccactgcacctggcacccaaattacttctagttctcaagttagatgattaatatcacacttttctcatgtatgttttatgatagcattgaatttttataattaaaaatttactaatgcaaacaagatttacagtctttaatacaatcttaattttggaattcatgaaggaatgactaagttctaatttttttttttttttttttgaaactgagtctcgctctgtcgcctaggctggagtgcagtggtgcaatctcagctcactgcaacctccgtctcccgggttcaagtgattctcctgcctcagcctgttgagtagctgggactacaggtgcgtaccaccaagcccagctaatttttttatatttttagtagagacggggtttcactgtgttagccaggatggtctcaatctcctgacctcatgatccgcccaccttggcctcccaaagtgttgggattacaggcatgagccactgcccctggacagatctaattttttaatagtgtaagagagatacactgtgcattccatctatgtcctgagttagtaattcaagtaccaaaaagtaatttaatatgaaactccttgaaaattcagagcttacacttgaattcaaaatgcctatttttgattgtttaaaagttacttaaacctgagctttaggacctttaaaatctcagcatgccttttaagctagtacttttcctgttttgagctctagcaaaccttcagcaagccaaggtggtagccctttttcaacacaatcaaaatagagaggtcaccagttgtttactaccttatggtaaaatgcccggatcaagatccatgtatcccccccatattgtgatgatgcaatcaaagcatagtttttttctactttctgaaatattactgatgaaatcactttacatttaagaggagaaaacagactgccttggattttttttttgtcttgagagaaaaaacaaaatatttagtattgcaagcataaacatttggactcaataaatgacaaattatgaaa

SEQ ID NO: 9733 - DNA, 1274 bp, Homo sapiens
gtgaaacatggcggtaggctgggaccataacacaaggtaaaatactgaaacaccgctgggtgctgttccctcggttgttccagggctgtttagggcgtaaatgcaattgagggaactgggagcctgtcatgggcttggcttcctgtcttcattgatctctagagagccggtcggacggagaagccgctccacctcccacgggggcgttactggcaggaccctaggcaacgatgctactgggagcttccctttgccaggtccgggtgcttgtgtgctatcctgcaactcgaaggagttcaggtgcttcctcgatcgcacctgattctgaccctttgcttgtcacagtgcccggttcccaggtggtttctccagtccgcaggcgagtaggatcccaatcggtcgagtcccagtcctcccggatgtcagactccctacccccattcagacaaatgccacattcgtggcagcacgttgccctctgtctctttaagagtcttggccttgcccggaaggagtttcgcacagtgcttcggaaaatgagaagggggcgggggagggcgagatgctgagagacagcatgactatatgaaggaagaggaaggttttcctgaagatgaggcgactgaatcggaaaaaaactttaagtttggtaaaagagttggatgcctttccgaaggttcctgagagctatgtagagacttcagccagtggaggtacagtttctctaatagcatttacaactatggctttattaaccataatggaattctcagtatatcaagatacatggatgaagtatgaatacgaagtagacaaggatttttctagcaaattaagaattaatatagatattactgttgccatgaagtgtcaatatgttggagcggatgtattggatttagcagaaacaatggttgcatctgcagatggtttagtttatgaaccaacagtatttgatctttcaccacagcagaaagagtggcagaggatgctgcagctgattcagagtaggctacaagaagagcattcacttcaagatgtgatatttaaaagtgcttttaaaagtacatcaacagctcttccaccaagagaagatgattcatcacagtctccaaatgcatgcagaattcatggccatctatatgtcaataaagtagcagggaattttcacataacagtgggcaaggcaattccacatcctcgtggtcatgcacatttggcagcacttgtcaaccatgaatcttacaatttttctcatagaatagatcatttgt

SEQ ID NO: 9734 - DNA, 432 bp, Homo sapiens
gtacgcgggagccccggcgacccgggcttctgtgaaacatggcggtaggctgggaccataacacaagagtttcaggccaggtgtggtggttcacatctataatcccagcactttttttgagaggccgaggtgggtggaaggcttcagcccaggagtttgagacccagcctgggcaacaagcatgactatatgaaggaagaggaaggttttcctgaagatgaggcgactgaatcggaaaaaaactttaagtttggtaaaagagttggatgcctttccgaaggttcctgagagctatgtagagacttcagccagtggaggtacagtttctctaatagcatttacaactatggctttattaaccataatggaattctcagtatatcaagatacatggatgaagtatgaatacgaagtagacaaggatttttctag

SEQ ID NO: 9735 - DNA, 695 bp, Homo sapiens
atttccgggtacgcgggagccccggcgacccgggcttctgtgaaacatggcggtaggctgggaccataacacaaggttattgtcataggataaattcctcaatgggcatttacttagaagaggagtggtgtgcatgactatatgaaggaagaggaaggttttcctgaagatgaggcgactgaatcggaaaaaaactttaagtttggtaaaagagttggatgcctttccgaaggttcctgagagctatgtagagacttcagccagtggaggtacagtttctctaatagcatttacaactatggctttattaaccataatggaattctcagtatatcaagatacatggatgaagtatgaatacgaagtagacaaggatttttctagcaaattaagaattaatatagatattactgttgccatgaagtgtcaatatgttggagcggatgtattggatttagcagaaacaatggttgcatctgcagatggtttagtttatgaaccaacagtatttgatctttcaccacagcagaaagagtggcagaggatgctgcagctgattcagagtaggctacaagaagagcattcacttcaagatgtgatatttaaaagtgcttttaaaagtacatcaacagctcttccaccaagagaagatgattcatcacagtctccaaatgcatgcagaattcatggccatc

SEQ ID NO: 9736 - DNA, 3949 bp, Homo sapiens
ggagggacctcactgccttgatctgttatttatcaagagtcaaactggaaaaggctgtcagggaaacctccaggctgcatcttgggcaaagattggcttgaaacaggcatttcccaagcctggccttggacaccaactgtaaaaaaaaggccattactggtgtttccttggttagttctgggtataagttctggatcctcactcatctcatctgcactgacatcctcactcacggcatttagagacttaacacgccagcctctgtgtgagcatttacctctttcaaccctcaccataatcccacaaggaggcacagttcttttacccattttgaagatgaagaaacacagtctcagagaagttcggtcacagtatcacaaggaggtaagtagcagagctgggattggagccccggcctttgtgatcccagagcaccagcaataccgtctcggcctcggctcctgggttataccctctgtcacgccaagcccatcagcccgcttgtgctgtctccctctgtctgtcctagttcggatggagatggcgagttctgctggctcctggctctctggctgcctcatccctctcgtcttcctccggctgtctgtgcatgtgtcaggtaggagtttctgatcctctttccctgcctggtacatgtgatattggcgtccccagaataaggaagcttggctggaaacattatgtcttttggggttctgttcccccggccctggcaatcctttccagagtccttcctgggctctgtccgtccccgggatatcctcttcctcatcccttcccaagctttctcctgccgtccctcccagttggccttgtctctttttttgtccaggccacgcaggggatgccggcaagttccacgtggccctactagggggcacagccgagctgctctgccctctctccctctggcccgggacggtacccaaggaggtgaggtggctgcggtccccattcccgcagcgctcccaggctgttcacatattccgggatgggaaggaccaggatgaagatctgatgccggaatataaggggaggacggtgctagtgagagatgcccaagagggaagtgtcactctgcagatccttgacgtgcgccttgaggaccaagggtcttaccgatgtctgatccaagttggaaatctgagtaaagaggacaccgtgatcctgcaggttgcagccccatctgtggggagtctctccccctcagcagtggctctggctgtgatcctgcctgtcctggtacttctcatcatggtgtgcctttgccttatctggaagcaaagaagagcaaaagaaaagcttctctatgaacatgtgacggaggtggacaatcttctttcagaccatgctaaagaaaaaggaaaactccataaagctgtcaagaaactccggagtgaactgaagttgaaaagagctgcagcaaactcaggctggagaagagcccggttgcattttgtggcagtgaccctggacccagacacagcacatcccaaactcatcctttctgaggaccaaagatgtgtaaggcttggagacagacggcagcctgtacctgacaacccccagagatttgatttcgttgtcagcatcctaggctctgagtacttcacgactggctgccactactgggaggtgtatgtgggagacaagaccaaatggattcttggagtatgtagtgagtcagtgagcaggaaggggaaggttactgcctcacctgccaatggacactggcttctgcgacagagtcgtgggaatgagtatgaagctctcacatccccgcagacctccttccgccttaaagagcctccacggtgtgtggggattttcctggactatgaagcaggagtcatctctttctacaatgtgaccaacaagtcccacatctttactttcacccacaatttctctggcccccttcgccctttctttgaaccttgccttcatgatggaggaaaaaacacagcacctctagtcatttgttcagaactacacaaatcagaggaatcaattgtccccaggccagaagggaaaggccatgctaatggagatgtgtccctcaaggtgaactcttctttactacccccgaaggccccagagctgaaggatataatcctgtccttgccccctgaccttggcccagcccttcaggagctcaaggctccttctttttagggatatgccacattacctgctcccatcaccatccagcccagcaccctggacttcagtcgcctggcccaaccccatgattatggaacgtctcttcaccttaacccaaatccagacccttttgtggtttctatttgtaccacttttctcccaggcctcagttctgaagcttacctttcttctaaggaattgaagctcccagtgacctggagggaggattcctggaaaccaaacaatcagtttaggtgcaggtggagatgttgaatatgtgttaccaagatacagcacaggttcagggaaaagagttcgctactccaggggttatttagaagacactttctctgcctcatcctgccctcaagctttagtcaagaagttatggcccccagtccctgacttcttacttatcccattgaggactgcctttctctctctcagttctggcctctgccccccaaagtcagctctctaaaagcaagcatgttttagaccactcactctttccctctttcttcaggaatgaattgggaaaggctgatgagtaaaacataccatccttttctattttcttgatgctgtttacaacatagtttggtgatatccagagctaatgtacatgctttcaaaagctaatctgcctgttgatggtaactaggtacagcgactttaaatacagttgctataatcctgaaaagccccaggagcacatcagggagctgggaaacacagttgcagagaactcagctgtatgttgccctctgaccttggcccagaccttcagaggctcagtctgttgagtctgttgtgactgtcttatgaatcaatctgttgtgccaaccctttctgagattcagagaggtccagctagaaaaagtggcagttttaaccaccaacgtagaagcttttttttccccacaagaccattgtactgcaatacttgagtatttgtgtagcaaacagcctcttaggttggagagtattgatttcaaataggaagttggtagactaggtgtgaggatgaaataatgaccttgatttttgggtgtgtattgcagaagcctcgtcgctttcaagtcacatcatatatgcgatctggcctaaccatggagatattggttatcagtttgcagatgaatacacagttctatccaacagaaactgtatctttctgtttgtcagaagttctccgttagttcctgtattagtcaaggttttccagagaaacagaatcaatatatattggggcaggggggcggtggttattataaggaattggctcacgtgattatggaggcggttaaatcccaagatctgcaggataagtcagcaagatggagtcccatgagagctgatggtttagttccagtctgatggcagcaggcttgacgccaaggaagagatgatgtttaattcaagtccgaaggcaaggaaaaagctgatggtcctgtccaaaggctattaggcaggaagaattctcttagggcagagttagctcttttgttctattcaggccttcaactgattcagcaaggcccgcccacatttgggaggacagtctgcattactcagtctactgatttgaatgttaatgtcattgagaaacaccctcacaggaacactcagaataatgtttgaccaaatagctgggcatcttgtgacccagttaagtggatacataagattaactatcacagtgactcagtggaattttttgtttgcttttgtacagttttaaaataaaagtttggtatttgtg

SEQ ID NO: 9737 - DNA, 3369 bp, Homo sapiens
cagagagagccctggcctctcatatttcataaaatatgaacttttcccggcccacatccctaggccttcctgatgcgcttgcctgctccctggtctctctgcatggggaaggagtgttcccagcttgcaaactccagctttgcctgtgagaggaacaagcgtccctgatccagaaggtgttcggatggagatggcgagttctgctggctcctggctctctggctgcctcatccctctcgtcttcctccggctgtctgtgcatgtgtcaggccacgcaggggatgccggcaagttccacgtggccctactagggggcacagccgagctgctctgccctctctccctctggcccgggacggtacccaaggaggtgaggtggctgcggtccccattcccgcagcgctcccaggctgttcacatattccgggatgggaaggaccaggatgaagatctgatgccggaatataaggggaggacggtgctagtgagagatgcccaagagggaagtgtcactctgcagatccttgacgtgcgccttgaggaccaagggtcttaccgatgtctgatccaagttggaaatctgagtaaagaggacaccgtgatcctgcaggttgcagccccatctgtggggagtctctccccctcagcagtggctctggctgtgatcctgcctgtcctggtacttctcatcatggtgtgcctttgccttatctggaagcaaagaagagcaaaagaaaagcttctctatgaacatgtgacggaggtggacaatcttctttcagaccatgctaaagaaaaaggaaaactccataaagctgtcaagaaactccggagtgaactgaagttgaaaagagctgcagcaaactcaggctggagaagagcccggttgcattttgtggcagtgaccctggacccagacacagcacatcccaaactcatcctttctgaggaccaaagatgtgtaaggcttggagacagacggcagcctgtacctgacaacccccagagatttgatttcgttgtcagcatcctaggctctgagtacttcacgactggctgccactactgggaggtgtatgtgggagacaagaccaaatggattcttggagtatgtagtgagtcagtgagcaggaaggggaaggttactgcctcacctgccaatggacactggcttctgcgacagagtcgtgggaatgagtatgaagctctcacatccccgcagacctccttccgccttaaagagcctccacggtgtgtggggattttcctggactatgaagcaggagtcatctctttctacaatgtgaccaacaagtcccacatctttactttcacccacaatttctctggcccccttcgccctttctttgaaccttgccttcatgatggaggaaaaaacacagcacctctagtcatttgttcagaactacacaaatcagaggaatcaattgtccccaggccagaagggaaaggccatgctaatggagatgtgtccctcaaggtgaactcttctttactacccccgaaggccccagagctgaaggatataatcctgtccttgccccctgaccttggcccagcccttcaggagctcaaggctccttctttttagggatatgccacattacctgctcccatcaccatccagcccagcaccctggacttcagtcgcctggcccaaccccatgattatggaacgtctcttcaccttaacccaaatccagacccttttgtggtttctatttgtaccacttttctcccaggcctcagttctgaagcttacctttcttctaaggaattgaagctcccagtgacctggagggaggattcctggaaaccaaacaatcagtttaggtgcaggtggagatgttgaatatgtgttaccaagatacagcacaggttcagggaaaagagttcgctactccaggggttatttagaagacactttctctgcctcatcctgccctcaagctttagtcaagaagttatggcccccagtccctgacttcttacttatcccattgaggactgcctttctctctctcagttctggcctctgccccccaaagtcagctctctaaaagcaagcatgttttagaccactcactctttccctctttcttcaggaatgaattgggaaaggctgatgagtaaaacataccatccttttctattttcttgatgctgtttacaacatagtttggtgatatccagagctaatgtacatgctttcaaaagctaatctgcctgttgatggtaactaggtacagcgactttaaatacagttgctataatcctgaaaagccccaggagcacatcagggagctgggaaacacagttgcagagaactcagctgtatgttgccctctgaccttggcccagaccttcagaggctcagtctgttgagtctgttgtgactgtcttatgaatcaatctgttgtgccaaccctttctgagattcagagaggtccagctagaaaaagtggcagttttaaccaccaacgtagaagcttttttttccccacaagaccattgtactgcaatacttgagtatttgtgtagcaaacagcctcttaggttggagagtattgatttcaaataggaagttggtagactaggtgtgaggatgaaataatgaccttgatttttgggtgtgtattgcagaagcctcgtcgctttcaagtcacatcatatatgcgatctggcctaaccatggagatattggttatcagtttgcagatgaatacacagttctatccaacagaaactgtatctttctgtttgtcagaagttctccgttagttcctgtattagtcaaggttttccagagaaacagaatcaatatatattggggcaggggggcggtggttattataaggaattggctcacgtgattatggaggcggttaaatcccaagatctgcaggataagtcagcaagatggagtcccatgagagctgatggtttagttccagtctgatggcagcaggcttgacgccaaggaagagatgatgtttaattcaagtccgaaggcaaggaaaaagctgatggtcctgtccaaaggctattaggcaggaagaattctcttagggcagagttagctcttttgttctattcaggccttcaactgattcagcaaggcccgcccacatttgggaggacagtctgcattactcagtctactgatttgaatgttaatgtcattgagaaacaccctcacaggaacactcagaataatgtttgaccaaatagctgggcatcttgtgacccagttaagtggatacataagattaactatcacagtgactcagtggaattttttgtttgcttttgtacagttttaaaataaaagtttggtatttgtgtttt

SEQ ID NO: 9738 - DNA, 3423 bp, Homo sapiens
ctcctggaggaaaatggcggtcgctggagccgccgaccaagaggcttgggagtctgtacctttcccgaccgggccactggaagttggagcctccgccgagtcgcagacaacgcctccgggagggccttcctgatgcgcttgcctgctccctggtctctctgcatggggaaggagtgttcccagcttgcaaactccagctttgcctgtgagaggaacaagcgtccctgatccagaaggtgttcggatggagatggcgagttctgctggctcctggctctctggctgcctcatccctctcgtcttcctccggctgtctgtgcatgtgtcaggccacgcaggggatgccggcaagttccacgtggccctactagggggcacagccgagctgctctgccctctctccctctggcccgggacggtacccaaggaggtgaggtggctgcggtccccattcccgcagcgctcccaggctgttcacatattccgggatgggaaggaccaggatgaagatctgatgccggaatataaggggaggacggtgctagtgagagatgcccaagagggaagtgtcactctgcagatccttgacgtgcgccttgaggaccaagggtcttaccgatgtctgatccaagttggaaatctgagtaaagaggacaccgtgatcctgcaggttgcagccccatctgtggggagtctctccccctcagcagtggctctggctgtgatcctgcctgtcctggtacttctcatcatggtgtgcctttgccttatctggaagcaaagaagagcaaaagaaaagcttctctatgaacatgtgacggaggtggacaatcttctttcagaccatgctaaagaaaaaggaaaactccataaagctgtcaagaaactccggagtgaactgaagttgaaaagagctgcagcaaactcaggctggagaagagcccggttgcattttgtggcagtgaccctggacccagacacagcacatcccaaactcatcctttctgaggaccaaagatgtgtaaggcttggagacagacggcagcctgtacctgacaacccccagagatttgatttcgttgtcagcatcctaggctctgagtacttcacgactggctgccactactgggaggtgtatgtgggagacaagaccaaatggattcttggagtatgtagtgagtcagtgagcaggaaggggaaggttactgcctcacctgccaatggacactggcttctgcgacagagtcgtgggaatgagtatgaagctctcacatccccgcagacctccttccgccttaaagagcctccacggtgtgtggggattttcctggactatgaagcaggagtcatctctttctacaatgtgaccaacaagtcccacatctttactttcacccacaatttctctggcccccttcgccctttctttgaaccttgccttcatgatggaggaaaaaacacagcacctctagtcatttgttcagaactacacaaatcagaggaatcaattgtccccaggccagaagggaaaggccatgctaatggagatgtgtccctcaaggtgaactcttctttactacccccgaaggccccagagctgaaggatataatcctgtccttgccccctgaccttggcccagcccttcaggagctcaaggctccttctttttagggatatgccacattacctgctcccatcaccatccagcccagcaccctggacttcagtcgcctggcccaaccccatgattatggaacgtctcttcaccttaacccaaatccagacccttttgtggtttctatttgtaccacttttctcccaggcctcagttctgaagcttacctttcttctaaggaattgaagctcccagtgacctggagggaggattcctggaaaccaaacaatcagtttaggtgcaggtggagatgttgaatatgtgttaccaagatacagcacaggttcagggaaaagagttcgctactccaggggttatttagaagacactttctctgcctcatcctgccctcaagctttagtcaagaagttatggcccccagtccctgacttcttacttatcccattgaggactgcctttctctctctcagttctggcctctgccccccaaagtcagctctctaaaagcaagcatgttttagaccactcactctttccctctttcttcaggaatgaattgggaaaggctgatgagtaaaacataccatccttttctattttcttgatgctgtttacaacatagtttggtgatatccagagctaatgtacatgctttcaaaagctaatctgcctgttgatggtaactaggtacagcgactttaaatacagttgctataatcctgaaaagccccaggagcacatcagggagctgggaaacacagttgcagagaactcagctgtatgttgccctctgaccttggcccagaccttcagaggctcagtctgttgagtctgttgtgactgtcttatgaatcaatctgttgtgccaaccctttctgagattcagagaggtccagctagaaaaagtggcagttttaaccaccaacgtagaagcttttttttccccacaagaccattgtactgcaatacttgagtatttgtgtagcaaacagcctcttaggttggagagtattgatttcaaataggaagttggtagactaggtgtgaggatgaaataatgaccttgatttttgggtgtgtattgcagaagcctcgtcgctttcaagtcacatcatatatgcgatctggcctaaccatggagatattggttatcagtttgcagatgaatacacagttctatccaacagaaactgtatctttctgtttgtcagaagttctccgttagttcctgtattagtcaaggttttccagagaaacagaatcaatatatattggggcaggggggcggtggttattataaggaattggctcacgtgattatggaggcggttaaatcccaagatctgcaggataagtcagcaagatggagtcccatgagagctgatggtttagttccagtctgatggcagcaggcttgacgccaaggaagagatgatgtttaattcaagtccgaaggcaaggaaaaagctgatggtcctgtccaaaggctattaggcaggaagaattctcttagggcagagttagctcttttgttctattcaggccttcaactgattcagcaaggcccgcccacatttgggaggacagtctgcattactcagtctactgatttgaatgttaatgtcattgagaaacaccctcacaggaacactcagaataatgtttgaccaaatagctgggcatcttgtgacccagttaagtggatacataagattaactatcacagtgactcagtggaattttttgtttgcttttgtacagttttaaaataaaagtttggtatttg

SEQ ID NO: 9739 - DNA, 5930 bp, Homo sapiens
agttgccctgtcagtgcaggtggaggccccggcggggcaaagtggcaggaacctcttaaagggcgagagcggcgcggagccagaacgcggtcggcccggtccccgccgcacccagcccagcaacatcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctgctcaggaagaactcagagaagatccagattttgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaaggtggaaaaaacccacatcgaggtgacagtacccacctcaaatggtgaccaaacacagaagcttgcagaaaaaactgaagatctgataagaatgaggaagaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccatggaattcttcgggaaatcctccaaggactcttgtcagctgtgttggaagccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacccactgaatattccgtgtgatctagaacagtgtggcagctttcacagcacaggaccgttcatcgggggcctaaacgtttccctcagctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaattttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttc

SEQ ID NO: 9740 - DNA, 2676 bp, Homo sapiens
agaacgcggtcggcccggtccccgccgcacccagcccagcaacatcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctgctcaggaagaactcagagaagatccagattttgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctag

SEQ ID NO: 9741 - DNA, 3029 bp, Homo sapiens
ggggcaaagtggcaggaacctcttaaagggcgagagcggcgcggagccagaacgcggtcggcccggtccccgccgcacccagcccagcaacatcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctcaccattacaattaagaattattttcagagtcttcttatttctgaagcatgtgaatattatctgcatcgttaaaagtcctgctcaggaagaactcagagaagatccagattttgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaaggtggaaaaaacccacatcgaggtgacagtacccacctcaaatggtgaccaaacacagaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctag

SEQ ID NO: 9742 - DNA, 5831 bp, Homo sapiens
agttgccctgtcagtgcaggtggaggccccggcggggcaaagtggcaggaacctcttaaagggcgagagcggcgcggagccagaacgcggtcggcccggtccccgccgcacccagcccagcaacatcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctgctcaggaagaactcagagaagatccagattttgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaagaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccatggaattcttcgggaaatcctccaaggactcttgtcagctgtgttggaagccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacccactgaatattccgtgtgatctagaacagtgtggcagctttcacagcacaggaccgttcatcgggggcctaaacgtttccctcagctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaattttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttc

SEQ ID NO: 9743 - DNA, 5751 bp, Homo sapiens
agttgccctgtcagtgcaggtggaggccccggcggggcaaagtggcaggaacctcttaaagggcgagagcggcgcggagccagaacgcggtcggcccggtccccgccgcacccagcccagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctgctcaggaagaactcagagaagatccagattttgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccatggaattcttcgggaaatcctccaaggactcttgtcagctgtgttggaagccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacccactgaatattccgtgtgatctagaacagtgtggcagctttcacagcacaggaccgttcatcgggggcctaaacgtttccctcagctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaattttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttc

SEQ ID NO: 9744 - DNA, 2402 bp, Homo sapiens
cgggagggcgcgcgccagggtcgctcgctcgctccctccctccgctggtgcgtttagtcagtcagccagcagcagccggcgggcccgcgagccgcagagggcccgagcctcggacgccggcgcctcctcctgccattgttcgtcgggctgcagcagtggcgggcgcaggagcccggccccggagccaccgcaacatcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctgctcaggaagaactcagagaagatccagattttgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaaggtggaaaaaacccacatcgaggtgacagtacccacctcaaatggtgaccaaacacagaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggagtgagtactttgtccacatgaccaattgtgaaaatggagggaataaatgtttttatgtattaa

SEQ ID NO: 9745 - DNA, 5928 bp, Homo sapiens
tgtgtctcactgctgtcatttgcttccatgtgccactgcggtgatggctccatggcctctcctggactggctgcgtgaccccgacggctgcttctggcaacatcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctgctcaggaagaactcagagaagatccagattttgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaaggtggaaaaaacccacatcgaggtgacagtacccacctcaaatggtgaccaaacacagaagcttgcagaaaaaactgaagatctgataagaatgaggaagaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccatggaattcttcgggaaatcctccaaggactcttgtcagctgtgttggaagccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacccactgaatattccgtgtgatctagaacagtgtggcagctttcacagcacaggaccgttcatcgggggcctaaacgtttccctcagctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaattttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttcaataaacaacaacaaaaagaa

SEQ ID NO: 9746 - DNA, 2853 bp, Homo sapiens
ggggcaaagtggcaggaacctcttaaagggcgagagcggcgcggagccagaacgcggtcggcccggtccccgccgcacccagcccagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctcaccattacaattaagaattattttcagagtcttcttatttctgaagcatgtgaatattatctgcatcgttaaaagtcctgctcaggaagaactcagagaagatccagattttgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaagaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctag

SEQ ID NO: 9747 - DNA, 5450 bp, Homo sapiens
agttgccctgtcagtgcaggtggaggccccggcggggcaaagtggcaggaacctcttaaagggcgagagcggcgcggagccagaacgcggtcggcccggtccccgccgcacccagcccagcaacatcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccatggaattcttcgggaaatcctccaaggactcttgtcagctgtgttggaagccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacccactgaatattccgtgtgatctagaacagtgtggcagctttcacagcacaggaccgttcatcgggggcctaaacgtttccctcagctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaattttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttc

SEQ ID NO: 9748 - DNA, 5639 bp, Homo sapiens
agttgccctgtcagtgcaggtggaggccccggcggggcaaagtggcaggaacctcttaaagggcgagagcggcgcggagccagaacgcggtcggcccggtccccgccgcacccagcccagcaacatcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctgctcaggaagaactcagagaagatccagattttgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggaactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccatggaattcttcgggaaatcctccaaggactcttgtcagctgtgttggaagccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacccactgaatattccgtgtgatctagaacagtgtggcagctttcacagcacaggaccgttcatcgggggcctaaacgtttccctcagctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaattttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttc

SEQ ID NO: 9749 - DNA, 5888 bp, Homo sapiens
agttgccctgtcagtgcaggtggaggccccggcggggcaaagtggcaggaacctcttaaagggcgagagcggcgcggagccagaacgcggtcggcccggtccccgccgcacccagcccagcaacatcatgacaacagagaagagtttagtgactgaggccgaaaattcacagcaccaacagaaggaagagggtgaggaagccataaactcaggccaacaagaacctcagcaggaggaatcttgtcaaacagcagctgaaggagataattggtgtgaacagaagctgaaagcttctaatggagacactcctacacatgaagacttgaccaagaacaaggagcggacatcagaaagcagaggactttcacgactattctcctcgtttctcaaaaggcccaaatctcaggtgtccgaggaagaaggcaaagaagtagagtcagataaagaaaaaggtgaaggaggtcagaaagagatagaatttggaaccagtcttgatgaagagatcattttaaaggccccaattgcagctcctgaaccggaactcaaaacagacccatctttggatcttcattcattaagcagtgcagaaacacagcctgctcaggaagaactcagagaagatccagattttgaaattaaggaaggagaaggacttgaagagtgctccaaaatagaagtaaaagaagaaagccctcaatcaaaagcagaaacagaattaaaagcttcccaaaaaccaatcagaaaacacaggaacatgcactgcaaggtttctttgttggatgacacagtttatgaatgtgttgtggagaaacatgctaagggacaagatttgcttaaacgagtatgtgagcatctcaatcttttggaagaagactattttggtctagccatttgggataacgcaacctctaagacatggctggattccgccaaagaaataaaaaagcaggttcgtggtgtcccttggaattttacatttaatgtaaagttttatccacctgacccagcacagttaacagaagacataacaagatattatttatgtcttcagcttcggcaggacatagttgcaggacgtctgccctgttcctttgcaaccttagcattattaggttcttacaccatccagtctgaactgggagactacgacccagaactccatggcgtggattatgttagtgattttaaactggccccgaatcagaccaaggaacttgaagagaaggtcatggaactgcataagtcatacaggtccatgactccagctcaggctgacttggagtttcttgagaatgccaaaaagttgtctatgtatggagttgatcttcataaagcaaaggacttggaaggagtagatatcatcctaggtgtctgctctagtggccttctggtttacaaagataagctgagaattaaccgcttcccttggcccaaagtgctgaagatttcttataaacgtagtagctttttcatcaagattcggcctggagagcaagagcagtatgaaagtaccatcggattcaaacttcccagttaccgagcagctaagaaattatggaaagtctgtgtagaacatcacacgtttttcagattgacatctacagacaccattcccaaaagcaaatttcttgcgctaggatccaaatttcgatacagtggccggactcaagctcagaccaggcaagctagtgctctaattgacaggcctgccccacacttcgagcgtacagcaagtaaacgggcgtcccggagcctcgatggagcagcagctgtcgattcggcagaccgaagtcctcggcccacttctgcacctgccattactcagggtcaggttgcagaaggtggcgtcctagatgcctctgctaaaaaaacagtggtccctaaagcacagaaggaaacagtgaaggctgaagtgaaaaaggaagacgagccacctgagcaagctgagccagagcccacagaagcatggaaggtggaaaaaacccacatcgaggtgacagtacccacctcaaatggtgaccaaacacagaaaaagagagaaagactagatggtgaaaacatttatatcagacatagcaatttaatgttggaggatttagacaagagtcaagaggagatcaaaaaacatcatgccagcatcagtgagctgaaaaagaacttcatggagtctgtaccagaaccacggcctagtgaatgggataaacgcttatccactcactcacccttccgaactcttaacatcaatgggcaaatccccacaggagaaggacctcccctggtgaagacacaaactgtcaccatctcagataatgccaatgctgtgaaaagtgaaatcccaaccaaagacgtccctattgtccacactgagaccaagaccatcacttatgaggctgcccagactgacgacaacagtggagacttggacccaggagtcttgctgacagctcaaactatcacatctgagaccccaagcagcaccaccacaactcaaattaccaagactgtaaaaggtgggatttcagagacacgtattgaaaagagaattgtgatcacaggagatgctgatattgaccatgatcaggtccttgtacaagccatcaaggaggcaaaggagcagcacccagacatgtcagtgaccaaggtggtcgtccaccaggagaccgagattgctgatgagtgagctcaggaactaacctaccccaactctgcccttctcccatccaagagaaaccagcaaaatgataaagaagctaacctgccatagtcagacttcagactttcaagattattctaaatcaccagaaaattaatttcagtttctattgggagtttataccaagagattcttctagatctcattgatccttttgaagagctttttctatattaggatatcagaattgttcaacttttcactctatagactgttttaagagttttggggtttttttaattgggtggtttgtaaccccttcagcctagcctctctgcccatttatttccaaccccaacagacactgacagggtccatggaattcttcgggaaatcctccaaggactcttgtcagctgtgttggaagccaaagccagcttagtgggacttccgcgtctctccctagtcttatcccctttggatgatggcagaaacttcatgaaccagccctttctcagagccagtgatgtgagtgtatcagaatgccagggagggcaccagccctgatccacagacctcggaaagatgcccctgttcctttgttgcgggtggttttggtaaggcagagccctctgctgagaatgtagtattgtttttcccctctccctcctgctttctttttggagcttctttgggtcaaagacatggaagttgcttcagatatctgatactgtgaatgtttgaacatatccgtggccttcacctctccagctacccttttacctcatcagaagcagtggctcagctaagtgctccccctagctcccatctcaggagaccaaatctcacagaaaaataggcactttgggccaaaagctctaatggaacatttttagtggtgatttggggaaggaaagttaatgaggtttttaaaataaggttttctagttttgagagtgtgcacttcacacaggggaatggggttacttctgtctgatcctgggcctttctttcatcccaaatgacaaggaatgtggctcagagaagggtttttcttttttgacctttcttctctcaacaggaacctgcctgaggacacccttctagagcaaggaattgacttttaggagccgttctccccacaagacaccacatgacaaggggtataagccccagccctgctcattcccactcaccagctgaggtctgtcaggttttgaaggcttgattttgtggtgggtttggggcttagttttcctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacccactgaatattccgtgtgatctagaacagtgtggcagctttcacagcacaggaccgttcatcgggggcctaaacgtttccctcagctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctcacgggaaatttctgcccaggatctcagccccaggctggttgtttctacaaatctctctcaaatgtattattttggtgacaaaaatgaaggagctttgtaaattttttttaaaattatgaatcatatcaagtagttgtttacatttcttgaaaaaataggaactcgggcagcagaatcagattggcagaatctttagactacacaggcaataatcaagtctgctgttttggcctttcgtagtagaagtggttgtagtgtttagatatctgtttggtcttgcttcttgtattgcatttttttc

SEQ ID NO: 9750 - DNA, 4707 bp, Homo sapiens
cgcaggatgcgcggggacgcgccaccgccctccgcgcccagttccgccggcgcttccccggcggctcccgggcgctgactctcccgggcttttccgcctttctcgctcccgccccgccgggcggttcggcggccggtccccggaccccgccgggagctgctcgtctcaccctcgccacggcgcggacaataaattaatgcatcgcgcttgagtggagggggcggctgggcgcctcggtggtagctttctctcctggctggagacgaccacaaccgacatgggctgtttctgcgctgttccggaagaattttactgcgaagttttgctcctggatgaatccaagttaacccttaccacccagcagcagggcatcaagaagtcaacgaaaggttccgttgtccttgaccacgtattccatcacgtaaaccttgtggagatagattattttgggctacgttactgtgacagaagccatcagacgtattggctggatcctgcaaaaacccttgctgaacacaaagaactgatcaacactggacctccatatactttgtattttggtattaaattctatgctgaagatccatgtaaacttaaagaagaaataaccagatatcagtttttcttgcaggtgaagcaagatgtccttcagggccgtctgccctgtcccgtcaacactgctgctcagctgggagcgtatgccatccagtcggagcttggagattatgacccatataaacatactgcaggatatgtatctgagtaccggtttgttcctgatcagaaggaagaacttgaagaagccatagaaaggattcataaaactctaatgggtcagattccttctgaggctgagctgaattacttgaggactgccaaatccctggagatgtatggcgttgacctccatcccgtctatggagaaaacaagtctgagtatttcttaggattaactccggttggtgttgttgtgtacaagaataaaaagcaagtggggaagtatttctggcctcggattacaaaggttcacttcaaggagactcaatttgaactcagagtactgggaaaagattgtaacgaaacctcattcttttttgaagctcggagtaaaactgcttgcaagcacctctggaagtgcagtgtggaacatcatacattttttagaatgccagaaaatgaatccaattcactgtcaagaaaactcagcaagtttggatccatacgttataagcaccgctacagtggcaggacagctttgcaaatgagccgagatctttctattcagcttccccggcctgatcagaatgtgacaagaagtcgaagcaagacttaccctaagcgaatagcacaaacacagccagctgaatcaaacagcatcagtaggataactgcaaacatggaaaatggagaaaatgaaggaacaattaaaattattgcaccttcaccagtaaaaagctttaagaaagcaaagaatgaaaatagccctgatacccaaagaagcaaatctcatgcaccgtgggaagaaaatggcccccagagtggactctacaattctcccagtgatcgcactaagtcgccaaagttcccttacacgcgtcgccgaaacccctcctgtggaagtgacaatgattctgtacagcctgtgaggaggaggaaagcccataacagtggtgaagattcagatcttaagcaaaggaggaggtcacgttcacgctgtaacaccagcagtggtagtgaatcagaaaattctaatagagaataccggaaaaagagaaacagaatacggcaggagaatgatatggttgattcagcgcctcagtgggaagctgtattaaggagacaaaaggaaaaaaaccaagccgaccccaacaacaggcgatccagacacagatctcgttcgagaagccccgatatccaagcaaaagaagagttatggaagcacattcaaaaagaacttgtggatccatccggattgtccgaagaacaattaaaagagattccatacactaaaatagagacacaaggtgacccaatccgcatcaggcattctcattcgccacgaagttaccgccagtatcgcaggtcccagtgttcagatggggagcgatcagttctctcggaagtgaattcaaaaacagatcttgtaccaccacttccggtgacccgttcttcggatgctcagggttctggggatgctacagttcatcagagaagaaatgggtctaaagatagcctgatggaagaaaaacctcagacatctacaaacaacctggctggaaaacacacagcaaaaacaataaaaactatacaagcttcccgcctcaagacagagacttgatcctgatgaagggtcaagggtaggggtgggaaggttgtgtgcgccactggtacttttgaaactgtgaaataggtatcttaattcaaatctcagacctgcaagtatttcttcagcatgagaaaatacattatcttttgcttctttttttttttttttttgagatgttatcactctgtcgcccaggctggagtgcagcggcaccgtgtcagctcaccgcagcctccacttactgggttaagcgattctcctgtctcaggctcccgagcagctgggattacaggcgtgcaccacaacacccggctaattctttttgtatttttagtagagacagggctttgccatgttggaggctggtctcgaactcctgacctcaagtgatccgcctgcctcagcctcccaaagtgctgggattataggccatggtttaactacagcacagttgtgctgaaggacctttttgttttaactggaagaataagtattttgtaaaaattcacttgataccacattttcatttctggaacaggatagcaatcattcatttctatcttgtgtctgtgtccaccacaaccaagaccagatgcatctgatgaacattctggaattctgaactgcagctagcctgctgtgcaatagtacaagtgggaggacgtcttcccagggctgggctggttctcaactagtgcccagatgcaaaaggactgaggcatcactttcagactgcatatatttttattcatataaagttctttataatactttattttgtggtgttaagttccaccagttatttacaaatgatgtaaaaagctttaagtgttgttaatttctaaagtgttcttgcgttttcagaagtgtaagtggatctcagttgatctgtcaccccaaacctcaaatgatccatccaccctgcttggccatctaattcacctgctctccccagtgactattttgtacctttcctctccatagatgactttgcaatctacagggaaaatacttatgcaggacatcttatatctcccccttaccacgtacagttctctccacagctgccagcagccctaacctttttgtctctccacctgtgctttggatgctcttctcccagccttttcaggatctttgtctgtcctcctatattaatgtattcaattattctctcagctagatccttgctacttggttttaaatttaagactaagattaaacaaaactatctttcacaaccacaaaccccctcccgccaagcaactaagattttcctctcattctcagccagttttcttgcaagcagtatctttagtcattgccctcaattcatctaatccctatcttaagctatctctaacatggatctttccctctactccactaatatcaatcactgtgttacttaatcccagggagaatttttaggacattcttttgcttctttaatataatcctattttgctcctaccactgaccatcctttctggcttatcatgctttaccttgccattaattagtggagtttctcaaacttcagaccctaggccctcttcctctaccaccagcagatctcatttatacccatggccttaaggtttatttctgtagtttagactactgagtaatgtgctactgcaaaaagaccatttgggtttctcaaaggtaatttaaaaattcagctgtttaaatgctgctccccagctgaatctagggtcattatgctcatcagtgtgcaagctggacacctagcagttatggacacctccactattaccacgtctagttggctctgtcatccaactataaacgatcttatttcactaattttactagtccaagctggtctcttgtctagacaacaataagcaacctagttcaactaccttttcttgcaaatctgattttccaccatggatttatcttgctttaataaagccagagggagcctgaagtggtctggcttctttacctacctcttcagcctcattttgtaacactctcacctcccataatagccatcttacaagcctcagtaaggactcagttctaaaacagggcactgaagagggaaagcagccaaaactgtctcaaaagtaagtggactaacggtatcttttttctagcccaagcctctgtatatgtcattcccccagttttgccttgtgaaaaatatgacacatacctttagtctcaactctttctcaggtttccctaagaaaatcctatcacggaactcatctcatagtgaagttttacatttgtgatgacattccctccacttatctatgtttccaaagggaagaactgtgttgtgctcatcatcgtgttctcagctcctagtacagtgctttcaataaattttttgaatacctcta

SEQ ID NO: 9751 - DNA, 5576 bp, Homo sapiens
caggccgccggcccgggagagcgcgcggcggcggcggcggcgggacggccccgagcgcgccctcccgcctgcggccactcgcagccggcgctggccgggccggcgcgccccgcaggcggctagagcgcggcctcggcctcggcgcgggcttgccccgggccgtagcccgcgagaggcggcgcgggcggccgagggcactgacggcgtcgcgggacgctcccgggcggcggcgcagcggcagcggcagcggcagcggcagcgcagggggcggaggcagggggcgcccccagccaggatgctgcggttcctgcgccggacctttggccgccgctccatgcagcgctacgcgcggggcgcggcggggcgcggggccgccgggctgggggacgagcgcgatggggggccacgggggggcccggccgccgccgcctcctcctcggcgctgcccgccgcgcccgggggcagcgtgttcccggcgggcggcgggcccctgctcaccggcggcgcggccgtgcacatctccgccgccggcgccgccaaggccaccctctactgccgcgtcttcctgctcgacgggaccgaagtgagcgtggacctgccgaaacatgccaaaggccaggatttgtttgatcagattgtgtaccacttggaccttgtggaaacagattactttggcctccagttcctcgactctgcccaggttgcgcactggctggatcatgccaaacccataaaaaagcagatgaaaattggacctgcttatgctttacactttcgagttaaatactattcttcagaaccaaacaaccttcgtgaggagtttacaaggtacctgtttgttttacaactcaggcatgacattctttctggaaaattgaaatgcccttatgaaacagctgtggaattagctgctctctgtctacaagcggagcttggggagtgcgagcttccagaacacacaccagagcttgtgtctgagtttcggttcattccaaatcagacagaagcaatggaatttgatatcttccagagatggaaagagtgcaggggaaagagccctgcccaggcggaactctcctatctgaataaagcgaagtggctggaaatgtatggggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcagtgggcggacagaatatcaagctacacatggctccaggttacgaagaaccagcacctttgagaggaagcctagtaaacgttatccatcccggagacattcaacgttcaaagcaagcaacccagtgatagcagcccagctctgctctaaaacaaatccagaagtccataattaccagcctcaatatcatcctaatatccatcccagccagccccggtggcatcctcactctccaaatgtcagctacccgctcccttccccagtgcttagcagctcggaccggttgccttttggcattgaggagaatgggggcacaccgttcctcaccgcagcttcaggaaggcatcaccaccagcaccagcatcagcatcagcaccagcaccactcaaactacagcctctcactgaccctggagaacaaagaggggcctctgaggtccccaaactccagcagcaagtcccttacaaaactgagtccaggaacacctgccttgttcagtgaagccgctgcccatctaaagaagctggaactggaaactgtgaaggctgctggaccctggcctcctctgcacatcaacataaacaaggctgaagaaaagaaagtctcggagaaaactcttcagactccacttttgccttcccctgttgcggatcatgtgaagtgtaacattctgaaagcccagttggaaaatgcttcccgagtgaacatccagggtggaaaggaggaatcaccgtttgtaaatatcaataagaaatccagtcttcaggacgctagtgtaagaagtcctattcctattcgtgtggaaactgcccagccagctgtggaaaagccggaaatcaagcctccccgagtgaggaagttaacaagacagtatagttttgatgaagacgacctccctccagacctggccgaggcagtgggagtgaccacatctacaaccacaaacaccacaacggccgccacacaagtctccgtgccgctgccgtcccccaaggtccagaatgtcagctcgcctcacaagtcagaaggcaaaggcctgctgtcccctggggccaagagcccctctgaccgaggaggtgcctttaccctggagccgggtgatcttctgatggatttcacagaagccactcctctggcagagcccgccagcaacccccactgtgcccactctcgctgttctcctccactctctctccccatgaaggaagagaccactggagtttgcatgtaccctccaatcaaaacgaggctgataaaaacattcccggttgatacaatgaacccgtttcctgatactttcaccacagggccacagtttactgcagacttcagagacagtaaattacagtgctgtcctggcccgacttccccgctgatcccagcagcgaccctgaggcctttgacagagaccgtccacagtgcagaccatttacaccacccggaaacctgtttctctggcagccagtgcagagacactccggcaggaactggagagagagaagatgatgaaaagactgttgatgaccgaactgtgaaattctccccttgtcacctggaagatggcatggtgccttctgtccgtcttctttcttcgggctttgtgtgctcactctagcacagcatacaagtgtgtgctctgttcgcccaggtctccatggttagttgaagccaatttctggcttgacttttatgggaaaagttattttatgtctcctaagcattagagtttttctattactctatgtagttgagacaggatttgataagtctaggaaaagaaagatgggaaaacgggattccttttcagaagtacctgtgtgtatctgttaataaccacaggggttaatatgatgtaggatcttttactatcaatttcaaccatttgattttgtatgattgaaacttgcaccgagctttgactgtttgttaaagagtcatttttaatgaaagaataattctttattgctggtttttcatttacactgataaatacacagatcttataaagtctttaacattcatttgtattcagatgtgagtagaagaactaaaaaaagaaagttacatatcactatgactgaaggtacttcagcttaatctgaaatataatttaacttgtgaactccttggatatgatattatttggaataaacagaatttatcattgaacccaaagtaggaaatgatagcttacattgtctaaaaatccttacaaggttaagatgattcaatatcaagaagattcagaaaattatttctaaagttgatcgattcatgtcgtattgatagaatcttgaccagaagaaattttgctctttttatatagtttcaagaaatgtgtttttaaatttttattaatgcacttgaacaactttgcaggaataaagcaaccccctaaccacaaaatatccctctaaattagttccctagctttctcaatgaatacacacatatttttacatagctatgatcgttgtgtacattctcctttgttttacttctcggcctaacacttgtctcctcttgtcaacacagattctactctcaccaatttaaatgtctttatatccatgtaacatgggtaacctcacttcaccccattattagatatttgagttatatctaatttttcactcttataaatagtgctgctatgaatgtctgtaaaaaaaaaaaactgctccttcttttggattattcccttaggaatatctccaaagagggattacaaggtcaaagagcatgaagtattttatagctcttgttttatattgccagattgctttctagaaagatccaatctttgggttggaaggaccttaaaggtcatctagtttagcctccccaccccctctgaatgcttgaatcccctcgacaatttatgatgccaccagcaatgtataagcatttctgtttaccaatagctctgccagtattgggttttgccatttttatttatttttgctagtttaataggtatgtatagttgttcttgaagagttgttttatttcattaattgctagcaaggctgagcacttttccatgtgatgatttactagttgtatttccttgtgtgtaaaatgttcattcatttcttatgaccacttgttaagaggaactgatctcatatatttgtatcagaactgtatttttatgttatattgtatagtttgctctcctgcccctctccttaaaactgaatggtgccaataatttgatactaatgactacaaaaaaaggtaatgcctcatttactagtattgttgtaaaatgaggaatgtatgtgaatattcagataaccgaggattaaccctttaagtgctgaatctttaaaattttaatatatttttttttgagggaaatctttctaaaatgtattacgcacttccctgccttagtaaacagagtatactggagagtatttaaccttttcttgatgagtcatggtcatgattataaacatcagccccttttataccttggtacggtgcagtgatatcattaagagctatcaatatgtgtagggcttggcttggccttttataggatattatgctgttctcactgatggttttttactgctctctgctctgtcagtggagctatccggggcaattgtagcgtttgggtccttttacccctatgtcccccggctatacttttaaaacagctttagctgttctttatcttgtgcacatgatacaaaatatgttcccgtacaatatggggctgtcacttcttgccaacccagcaccctcttcctcttctaacctgctttctgaggcttctgctcttcacctcctgctcgctgatggaaacctccagggcaaagctgaaggtttcttggggaagccaggaaagccagtatttcctatgtgtcagatctgcttggcttccaagaagggatgcatgggctttttggccagtgtttccaggaggctctgggcttcctgcttcttccccgcttcccccagagttcacagatgttgaagtttctgaaggttgacgtcactggaagtctgaccacaaacaagttggctgttactgtatttgaaacccagtacctttggcagctcacctctaaccagtaaaataagaggattccatggtttca

SEQ ID NO: 9752 - DNA, 2962 bp, Homo sapiens
tgggatatgggatattgtaatgggagagcaggaaatttaaggtcggaggtatttgtttaggatacctcagtattctagagctatgggatttattttgctttgaagtccagaggtatttagctttattctaaaagcgatgaagttcctcttaattaaagacgctcctggaaaaaaaaaaaggaaaaatttaatgctgtcttttaaaaggaaacatgccaaaggccaggatttgtttgatcagattgtgtaccacttggaccttgtggaaacagattactttggcctccagttcctcgactctgcccaggttgcgcactggctggatcatgccaaacccataaaaaagcagatgaaaattggacctgcttatgctttacactttcgagttaaatactattcttcagaaccaaacaaccttcgtgaggagtttacaaggtacctgtttgttttacaactcaggcatgacattctttctggaaaattgaaatgcccttatgaaacagctgtggaattagctgctctctgtctacaagcggagcttggggagtgcgagcttccagaacacacaccagagcttgtgtctgagtttcggttcattccaaatcagacagaagcaatggaatttgatatcttccagagatggaaagagtgcaggggaaagagccctgcccaggcggaactctcctatctgaataaagcgaagtggctggaaatgtatggggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcagtgggcggacagaatatcaagctacacatggctccaggttacgaagaaccagcacctttgagaggaagcctagtaaacgttatccatcccggagacattcaacgttcaaagcaagcaacccagtgatagcagcccagctctgctctaaaacaaatccagaagtccataattaccagcctcaatatcatcctaatatccatcccagccagccccggtggcatcctcactctccaaatgtcaggccatcctttcaggatgacaggtcgcattggaaagcatcggccagtggagatgacagccattttgattatgtccacgaccagaaccagaagaacttaggagggatgcaaagtatgatgtatcgagataaactcatgactgcactttgagagactgaagcatctctcttccattcaccttcatagtttcattgcattccatgaaaagtgtcttggcctcagatggatggatgtgtttggacgagtgtctttaaggagtagtcctgaaaggtgtttttggtgtccatgtaaatatttgaagataaaaccactatagcttgtcataatttactgttgactgcattctcattaaaatgaaggtaaaggctcaggaatcatattgatgttctgattttaaaattggagtcaaagtctatgtttatcattttactatgttcctgatgttctttgttatttaattaatgggagcaaataaaaccagaagagcttgggaagattgctcagcatatattcctgtcgtagaagttgagattgctagggtccagtttccctagtgtggcctggacgagtcatttccccttcattgacctcattttccccatctgaaaagagagggttggactaagtgatctccaaggtcctttccaactctaaaattctgcaatttgttaacatttcattttgtttaggttgaggacatacattcaaactaattttatcacaaggaaaactgcaatacccacttccttgacagagttactcctttcagaagctaaataaagtatataacttattagatgttatatagatacagggggactttgaatttcacatcttaaagcagttgagctactttgaatttaagcagtcgtactaatcttaaattgcatagcatttgttttgatcgaatttgctgctcaagtatgggaataatttttaatgtcttaatgattggtgctgctaacttgcgtgatttcagaagacataattgtgaatacacactgtcagaattgggggattggtttttaccctagacttcactcttaaaaagcaacgtgcaatcaagatcatttatggctcaaatgaaagcatataaggttttcttgaagttgtgccaaagcattctgtagagtaggatgagatggttgttgccctagtctgttggtagaaccagaaatcaatatgttgtcttttaggttaaagcttgtaccaaaatatttatttcccccatttcaagccctgagtcaaacatttttttctcttaataatagacctgaaatgttttattagtatttctgtgaaatcagttgattcttgtgccatttttgtatatgtaattgtaattttgcccatgttaggccctctaaaaaatgtttgacatcctttgagatattttattactaaaatctgatcttttttggctactgcaaaaatctattcagcaagaaggtatcagctgcataccttgcacagtggagctgactacctataaactctccctaaggcatttgtttacaggtgtattccattttagcagacgttctgatgctcagtgtatgtgctgcatacaaataaatgtgttctgaatcttttcatcttattgatagcatttttacaaatgtgtttccaaggaataaagattattcttgcttt

SEQ ID NO: 9753 - DNA, 3843 bp, Homo sapiens
ggaaaaggcgccttgggagcgggcgctcggcggggcctcctcgggccccgggcgcggcgcggcgagtgggagcgagcgcgccaggaccacgcaggcgccctgctccggctggccctcggccggcgcgcggcgcgggagcagcccgcagcccgcctcccgcgcccccggcagccccctggcagcccgcagccgcccgtccggagcagcccctcggcagcccgcgcaggccgccggcccgggagagcgcgcggcggcggcggcggcgggacggccccgagcgcgccctcccgcctgcggccactcgcagccggcgctggccgggccggcgcgccccgcaggcggctagagcgcggcctcggcctcggcgcgggcttgccccgggccgtagcccgcgagaggcggcgcgggcggccgagggcactgacggcgtcgcgggacgctcccgggcggcggcgcagcggcagcggcagcggcagcggcagcgcagggggcggaggcagggggcgcccccagccaggatgctgcggttcctgcgccggacctttggccgccgctccatgcagcgctacgcgcggggcgcggcggggcgcggggccgccgggctgggggacgagcgcgatggggggccacgggggggcccggccgccgccgcctcctcctcggcgctgcccgccgcgcccgggggcagcgtgttcccggcgggcggcgggcccctgctcaccggcggcgcggccgtgcacatctccgccgccggcgccgccaaggccaccctctactgccgcgtcttcctgctcgacgggaccgaagtgagcgtggacctgccgaaacatgccaaaggccaggatttgtttgatcagattgtgtaccacttggaccttgtggaaacagattactttggcctccagttcctcgactctgcccaggttgcgcactggctggatcatgccaaacccataaaaaagcagatgaaaattggacctgcttatgctttacactttcgagttaaatactattcttcagaaccaaacaaccttcgtgaggagtttacaaggtacctgtttgttttacaactcaggcatgacattctttctggaaaattgaaatgcccttatgaaacagctgtggaattagctgctctctgtctacaagcggagcttggggagtgcgagcttccagaacacacaccagagcttgtgtctgagtttcggttcattccaaatcagacagaagcaatggaatttgatatcttccagagatggaaagagtgcaggggaaagagccctgcccaggcggaactctcctatctgaataaagcgaagtggctggaaatgtatggggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcagtgggcggacagaatatcaagctacacatggctccaggttacgaagaaccagcacctttgagaggaagcctagtaaacgttatccatcccggagacattcaacgttcaaagcaagcaacccagtgatagcagcccagctctgctctaaaacaaatccagaagtccataattaccagcctcaatatcatcctaatatccatcccagccagccccggtggcatcctcactctccaaatgtcaggccatcctttcaggatgacaggtcgcattggaaagcatcggccagtggagatgacagccattttgattatgtccacgaccagaaccagaagaacttaggagggatgcaaagtatgatgtatcgagataaactcatgactgcactttgagagactgaagcatctctcttccattcaccttcatagtttcattgcattccatgaaaagtgtcttggcctcagatggatggatgtgtttggacgagtgtctttaaggagtagtcctgaaaggtgtttttggtgtccatgtaaatatttgaagataaaaccactatagcttgtcataatttactgttgactgcattctcattaaaatgaaggtaaaggctcaggaatcatattgatgttctgattttaaaattggagtcaaagtctatgtttatcattttactatgttcctgatgttctttgttatttaattaatgggagcaaataaaaccagaagagcttgggaagattgctcagcatatattcctgtcgtagaagttgagattgctagggtccagtttccctagtgtggcctggacgagtcatttccccttcattgacctcattttccccatctgaaaagagagggttggactaagtgatctccaaggtcctttccaactctaaaattctgcaatttgttaacatttcattttgtttaggttgaggacatacattcaaactaattttatcacaaggaaaactgcaatacccacttccttgacagagttactcctttcagaagctaaataaagtatataacttattagatgttatatagatacagggggactttgaatttcacatcttaaagcagttgagctactttgaatttaagcagtcgtactaatcttaaattgcatagcatttgttttgatcgaatttgctgctcaagtatgggaataatttttaatgtcttaatgattggtgctgctaacttgcgtgatttcagaagacataattgtgaatacacactgtcagaattgggggattggtttttaccctagacttcactcttaaaaagcaacgtgcaatcaagatcatttatggctcaaatgaaagcatataaggttttcttgaagttgtgccaaagcattctgtagagtaggatgagatggttgttgccctagtctgttggtagaaccagaaatcaatatgttgtcttttaggttaaagcttgtaccaaaatatttatttcccccatttcaagccctgagtcaaacatttttttctcttaataatagacctgaaatgttttattagtatttctgtgaaatcagttgattcttgtgccatttttgtatatgtaattgtaattttgcccatgttaggccctctaaaaaatgtttgacatcctttgagatattttattactaaaatctgatcttttttggctactgcaaaaatctattcagcaagaaggtatcagctgcataccttgcacagtggagctgactacctataaactctccctaaggcatttgtttacaggtgtattccattttagcagacgttctgatgctcagtgtatgtgctgcatacaaataaatgtgttctgaatcttttcatcttattgatagcatttttacaaatgtgtttccaaggaataaagattattcttgctttttttttgactccatcttcattttttttaaattgattcttgttgctatgcagaagtctcatttgtgaatgaccttggtaacagaacagttggcttttggaagtctgaaggtgagcattcagttaggtgggtggagcaagatcatcctagaatgaggctgctcttggcaagagtggatcttataggcacagcagctgatgcctttcttcatctggggcaactctggtgaaggttgtcctgcctgtcacaggtgctgagtagagagaa

SEQ ID NO: 9754 - DNA, 5800 bp, Homo sapiens
ggaaaaggcgccttgggagcgggcgctcggcggggcctcctcgggccccgggcgcggcgcggcgagtgggagcgagcgcgccaggaccacgcaggcgccctgctccggctggccctcggccggcgcgcggcgcgggagcagcccgcagcccgcctcccgcgcccccggcagccccctggcagcccgcagccgcccgtccggagcagcccctcggcagcccgcgcaggccgccggcccgggagagcgcgcggcggcggcggcggcgggacggccccgagcgcgccctcccgcctgcggccactcgcagccggcgctggccgggccggcgcgccccgcaggcggctagagcgcggcctcggcctcggcgcgggcttgccccgggccgtagcccgcgagaggcggcgcgggcggccgagggcactgacggcgtcgcgggacgctcccgggcggcggcgcagcggcagcggcagcggcagcggcagcgcagggggcggaggcagggggcgcccccagccaggatgctgcggttcctgcgccggacctttggccgccgctccatgcagcgctacgcgcggggcgcggcggggcgcggggccgccgggctgggggacgagcgcgatggggggccacgggggggcccggccgccgccgcctcctcctcggcgctgcccgccgcgcccgggggcagcgtgttcccggcgggcggcgggcccctgctcaccggcggcgcggccgtgcacatctccgccgccggcgccgccaaggccaccctctactgccgcgtcttcctgctcgacgggaccgaagtgagcgtggacctgccgaaacatgccaaaggccaggatttgtttgatcagattgtgtaccacttggaccttgtggaaacagattactttggcctccagttcctcgactctgcccaggttgcgcactggctggatcatgccaaacccataaaaaagcagatgaaaattggacctgcttatgctttacactttcgagttaaatactattcttcagaaccaaacaaccttcgtgaggagtttacaaggtacctgtttgttttacaactcaggcatgacattctttctggaaaattgaaatgcccttatgaaacagctgtggaattagctgctctctgtctacaagcggagcttggggagtgcgagcttccagaacacacaccagagcttgtgtctgagtttcggttcattccaaatcagacagaagcaatggaatttgatatcttccagagatggaaagagtgcaggggaaagagccctgcccaggcggaactctcctatctgaataaagcgaagtggctggaaatgtatggggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcagtgggcggacagaatatcaagctacacatggctccaggttacgaagaaccagcacctttgagaggaagcctagtaaacgttatccatcccggagacattcaacgttcaaagcaagcaacccagtgatagcagcccagctctgctctaaaacaaatccagaagtccataattaccagcctcaatatcatcctaatatccatcccagccagccccggtggcatcctcactctccaaatgtcagctacccgctcccttccccagtgcttagcagctcggaccggttgccttttggcattgaggagaatgggggcacaccgttcctcaccgcagcttcaggaaggcatcaccaccagcaccagcatcagcatcagcaccagcaccactcaaactacagcctctcactgaccctggagaacaaagaggggcctctgaggtccccaaactccagcagcaagtcccttacaaaactgagtccaggaacacctgccttgttcagtgaagccgctgcccatctaaagaagctggaactggaaactgtgaaggctgctggaccctggcctcctctgcacatcaacataaacaaggctgaagaaaagaaagtctcggagaaaactcttcagactccacttttgccttcccctgttgcggatcatgtgaagtgtaacattctgaaagcccagttggaaaatgcttcccgagtgaacatccagggtggaaaggaggaatcaccgtttgtaaatatcaataagaaatccagtcttcaggacgctagtgtaagaagtcctattcctattcgtgtggaaactgcccagccagctgtggaaaagccggaaatcaagcctccccgagtgaggaagttaacaagacagtatagttttgatgaagacgacctccctccagacctggccgaggcagtgggagtgaccacatctacaaccacaaacaccacaacggccgccacacaagtctccgtgccgctgccgtcccccaaggtccagaatgtcagctcgcctcacaagtcagaaggcaaaggcctgctgtcccctggggccaagagcccctctgaccgaggaggtgcctttaccctggagccgggtgatcttctgatggatttcacagaagccactcctctggcagagcccgccagcaacccccactgtgcccactctcgctgttctcctccactctctctccccatgaaggaagagaccactggagtttgcatgtaccctccaatcaaaacgaggctgataaaaacattcccggttgatacaatgaacccgtttcctgatactttcaccacagggccacagtttactgcagacttcagagacagtaaattacagtgctgtcctggcccgacttccccgctgatcccagcagcgaccctgaggcctttgacagagaccgtctccacagtgcagaccatttacaccacccggaaacctgtttctctggcagccagtgcagagacactccggcaggaactggagagagagaagatgatgaaaagactgttgatgaccgaactgtgaaattctccccttgtcacctggaagatggcatggtgccttctgtccgtcttctttcttcgggctttgtgtgctcactctagcacagcatacaagtgtgtgctctgttcgcccaggtctccatggttagttgaagccaatttctggcttgacttttatgggaaaagttattttatgtctcctaagcattagagtttttctattactctatgtagttgagacaggatttgataagtctaggaaaagaaagatgggaaaacgggattccttttcagaagtacctgtgtgtatctgttaataaccacaggggttaatatgatgtaggatcttttactatcaatttcaaccatttgattttgtatgattgaaacttgcaccgagctttgactgtttgttaaagagtcatttttaatgaaagaataattctttattgctggtttttcatttacactgataaatacacagatcttataaagtctttaacattcatttgtattcagatgtgagtagaagaactaaaaaaagaaagttacatatcactatgactgaaggtacttcagcttaatctgaaatataatttaacttgtgaactccttggatatgatattatttggaataaacagaatttatcattgaacccaaagtaggaaatgatagcttacattgtctaaaaatccttacaaggttaagatgattcaatatcaagaagattcagaaaattatttctaaagttgatcgattcatgtcgtattgatagaatcttgaccagaagaaattttgctctttttatatagtttcaagaaatgtgtttttaaatttttattaatgcacttgaacaactttgcaggaataaagcaaccccctaaccacaaaatatccctctaaattagttccctagctttctcaatgaatacacacatatttttacatagctatgatcgttgtgtacattctcctttgttttacttctcggcctaacacttgtctcctcttgtcaacacagattctactctcaccaatttaaatgtctttatatccatgtaacatgggtaacctcacttcaccccattattagatatttgagttatatctaatttttcactcttataaatagtgctgctatgaatgtctgtaaaaaaaaaaaactgctccttcttttggattattcccttaggaatatctccaaagagggattacaaggtcaaagagcatgaagtattttatagctcttgttttatattgccagattgctttctagaaagatccaatctttgggttggaaggaccttaaaggtcatctagtttagcctccccaccccctctgaatgcttgaatcccctcgacaatttatgatgccaccagcaatgtataagcatttctgtttaccaatagctctgccagtattgggttttgccatttttatttatttttgctagtttaataggtatgtatagttgttcttgaagagttgttttatttcattaattgctagcaaggctgagcacttttccatgtgatgatttactagttgtatttccttgtgtgtaaaatgttcattcatttcttatgaccacttgttaagaggaactgatctcatatatttgtatcagaactgtatttttatgttatattgtatagtttgctctcctgcccctctccttaaaactgaatggtgccaataatttgatactaatgactacaaaaaaaggtaatgcctcatttactagtattgttgtaaaatgaggaatgtatgtgaatattcagataaccgaggattaaccctttaagtgctgaatctttaaaattttaatatatttttttttgagggaaatctttctaaaatgtattacgcacttccctgccttagtaaacagagtatactggagagtatttaaccttttcttgatgagtcatggtcatgattataaacatcagccccttttataccttggtacggtgcagtgatatcattaagagctatcaatatgtgtagggcttggcttggccttttataggatattatgctgttctcactgatggttttttactgctctctgctctgtcagtggagctatccggggcaattgtagcgtttgggtccttttacccctatgtcccccggctatacttttaaaacagctttagctgttctttatcttgtgcacatgatacaaaatatgttcccgtacaatatggggctgtcacttcttgccaacccagcaccctcttcctcttctaacctgctttctgaggcttctgctcttcacctcctgctcgctgatggaaacctccagggcaaagctgaaggtttcttggggaagccaggaaagccagtatttcctatgtgtcagatctgcttggcttccaagaagggatgcatgggctttttggccagtgtttccaggaggctctgggcttcctgcttcttccccgcttcccccagagttcacagatgttgaagtttctgaaggttgacgtcactggaagtctgaccacaaacaagttggctgttactgtatttgaaacccagtacctttggcagctcacctctaaccagtaaaataagaggattccatggtttc

SEQ ID NO: 9755 - DNA, 6628 bp, Homo sapiens
aagagcggagcgctccgccctgggggcggagctgggagggagctttaaggggtggacgggcgggaggtcggggtcctccggggattagagccggtgggctcgttgtgggcgccatttctcggcgtctaccgaggagccgcccctttctcagccttgctcggctcttccccgctctggtcgccggggctgcgccgtccccagctcagtgacaaaaatgctgagtttcttccgtagaacactagggcgtcggtctatgcgtaaacatgcagagaaggaacgactccgagaagcacaacgcgccgccacacatattcctgcagctggagattctaagtccatcatcacgtgtcgggtgtcccttctggatggtactgatgttagtgtggacttgccaaaaaaagccaaaggacaagagttgtttgatcagattatgtaccacctggacctgattgaaagcgactattttggtctgagatttatggattcagcacaagtagcacattggttggatggtacaaaaagcatcaaaaagcaagtaaaaattggttcaccctattgtctgcatcttcgagttaagttttattcctcagaaccaaataaccttcgtgaggagctaacccggtatttatttgttcttcagttaaaacaagatattctcagtggaaaattagactgtccctttgatacagcagtgcaattggcagcttataatctgcaagctgaacttggtgactatgatcttgctgagcatagtcctgaacttgtctcagagttcagattcgtgcctattcagactgaagagatggaactggctatttttgagaaatggaaggaatacagaggtcaaacaccagcacaggctgaaaccaattatctgaataaagccaaatggctagaaatgtatggggttgatatgcatgtggtcaaggctagagatgggaatgactatagtttgggactaacaccaacaggagtccttgtttttgaaggagataccaaaattggcttatttttttggccgaagataaccagattggattttaagaagaataaattaaccttggtggttgtagaagatgatgatcagggcaaagaacaggaacatacatttgtctttagactggatcatccaaaagcatgcaaacatttatggaaatgtgctgtggagcatcatgctttcttccgccttcgaggccccgtccaaaagagttctcatcgatcaggatttattcgactaggatcacgatttagatatagtgggaaaacagagtatcagaccacaaaaaccaataaagcaagaagatcaacatcctttgaaagaaggcccagcaaacgatattctagacgaactctacaaatgaaagcatgtgctacaaaacctgaagaacttagtgttcacaataatgtttcgacccaaagtaatggctcccaacaggcttgggggatgagatctgctctgcctgtgagtccttccatttcctctgctcctgtgccagtggagatagagaatcttccacagagtcctggaacagaccagcatgacaggaaatgcattcctctgaatattgatttgctgaatagcccagacttattggaagcaacgattggtgatgtaattggggcatctgacactatggaaacatcccaagcactgaatgacgttaatgtagccaccaggcttccgggattaggggaacctgaagttgaatatgagacattaaaagacacctcagagaagctcaaacagcttgagatggagaacagtcctttgctgtcccctcgatccaacatcgatgttaacataaacagccaggaggaagtggtgaagttgactgagaaatgccttaataatgtcattgagagcccaggattgaatgtcatgagagttcctcctgacttcaagagtaacattttgaaggctcaagtagaagcagtgcataaggttacaaaagaagatagcttattaagtcataaaaatgccaatgttcaggatgctgccacaaacagtgctgtgttaaatgagaataatgtgcccctccccaaagagtctcttgagactctgatgcttatcacacctgccgacagtggttctgttctaaaggaagctacagatgaattggatgccttgcttgcatctctaactgagaatctaattgatcacacagttgcacctcaggtgtcttccacatccatgatcacaccccggtggattgttccgcagagtggtgccatgtctaatggacttgcgggatgtgaaatgcttttgacagggaaggagggacatggtaataaagatggaatctcactgatctctcccccagcgccattcttggtagatgctgtgaccagctctggtcccattttggcagaagaagctgtcctgaagcagaagtgtttactgaccactgagctctgagggcctgtagctggaatacgcatctctccagcattccgtcctgggatccgtttcagctagaatatgttggattcaggagcttgtccattatttgtaggtaaaaaaagctgcacgtagatttgacttcaactccgtaaaaaagacagctgtattttccgtccaactggaattgttgaatcacactgcatagctgcccaaaagagagtgtttggtcttgaactttctatacttttataaatgttacaaattcccgaaagaagggaatttctttttctggggtttccttcaaactcttggctccacctagcggttctatttgttcataacaacttcataacaagcctgcctctggtagtcaacagccttttgaaagctatttccatctagtatcagggtgagagcatccttgatctggctgcctgttagagaaattgcacttttcctgacttacctagaaatcaagaatttaggaaattaatgtggacactataaaggcagacttagggccaacttttttttttttttacaattattacaacactaaagagaagtttagaatatagagagtttttaaatgtctcccattcttttgatttcttactgtactggctatcttaatatttcaagtttacatcaagataaaccctgagaagaactacggagaaatcaaataaaatcctgtcatatttttttcaccctgcctttccacaggaagcactcacaggcaccacacacgtatcatgtaacttatcagtggggtgggttactgttgaagagaccctggggcatttacctcaggcatctgcactcctccgagcccggtggagaatgcaggctgctgtagtctcaggtaatgaaggcacagcacagcagtactccacattgtttcctatttggacatagacttcatttcctttcagtataagctgaataaatttagagctttcaaactggaaaaaaaaatgaaacaaaacaaatacaccaagaccaaaataggcaataggaacaggggtgaagggatgttgtttcttaaatacctaccatgtatgaagctatacacagcatataccgaaagaacctgcattgcactaggaattctgtgttagtttaaaagagatctctaaaacttccccatccctttgggcctgtacaaagaaattctggatgttaaaataatatatactcatcacagaaaaataaagtatagcaatgtccatctgtaattctaatacccagaaataacgctatttagctttataattttcgaatgaacaaggtaaacctcggttgccatggggaagaaggatgatgtggaaaccatattggtaaagttgttaatccctcgttatggagaactgatcttaagctatacctcctggaatttgctttctagttttctgtcctgcaatatgtatataattaagcactaatttgtactgcttagcataaaagaacatccagtcttagatccttaaaacttcatggattggactttcctgggctccttataacataatcgtgtgtccaggcaaacgcacactagtgtctgactggaaagctcaggaattttaatcttgcactgtttcccagggagctgtagtgattggaacccacgtttgcacaaaacatttttgcagaaggaaagtcaacacttcttgctggctgcctccccttagccattatgctaaaaacagcttctgagtttcactggtggggctcttgccagttcttaattataggacatattttctcaaagctgaaggtgacacctagaaccaggggcttgacccaggacatgatggaatgagcatcaaattttcagtgtcttggcaaccgtagatgtcctacagggttaccgttgtgctgctcaccacagagcagctgaggcattatgccttggaagacctaaatctcccatccagttcaggaggtgacaacatccttattttaaacttcctaaaattaggaattaggtagttggacatagtctgtgacctttatgtcgttggatacctgtattcttgacagttagaatattggtagggactttgttaaaattcacttgaatttcaagctcagaggaaactttgtctcatgccctgacatgaagtggcaaacacggaagttcatacttgaatgctgaattggccccgacagattaaatgcgtgttggggattggtttcctgtcatagctgctgctgctgccatgcgcagagctgctgtaacagctcttcctgttctgctcccctgagaacagtgtggtggggagaggcagggctgaggtggtctacgaatgtggcaggtagggaaggggagatgtctgtctcttgagaagagagaggcatgtgtgccggcatccttgatgggttcaaagagaaaggttggagatgatagtgggtgagaagcaggctggtgagactgggctgaggttggagaaggggcagccgggggcactgctgagggtttgccgtgcacgcctcggacggagcacggtggggtggcggggagcagatagtgctgcctccctgcgggcagacaggagaggaacctcaactcagtccatttcatagccctgataggggaagtgggagttgacaggatggtttaaaataagacgtgaaggtttcagttacctgctctagactttgcctgagaacttgtaaattaatcagtgagacctaatttgtgacatgtcagtagcatcatcttttgacacacaggaggtcatggtcatttcattcctactcttcaggagacactgctgaacagaggaatgattctgttccttgtgtgcttacttccttaacatttatacattgttttaagaaaaaacttttaaaaatatttcttatagtctcctaacatttgtctctagcctttgcctttgtacaatcacagatatcctatggagatttaaggatgaaagccctgagttgttcttgggttcttggatctggactacttgttatcttatgcttctcacttctggctaaaacttgcacctcttcttctcttagctaagccccaaaatgaagatttccttcagaagtcttgttagcagaattatttatcagtcacagagagaaaaatctgctatttttctaagtaagagtctcgagaagcagagtttttgtcttgtcattgagaggagtcagcagtcttgttctgtaaaggaccagagatggtaaatactgtcccactcagctctgctggcgcagtacagcagcagcagccccagcacagctgtgttcctgcggagtcccctttacaaagccgctgacccctgatgtgaaactttgtagagcagcagagtggctgcgtgaaacgggaggctggcaggtcctcagataggttctgcagtgttacctgtcacttggaggcagccaacacttctggacattgcatccttattcacacatgtggcagctgaacgaggtgctgttgtgggtgtctcagctctgagggtctttgtgagctcccactgttgtgggtgtctcagctctgagggtctttgtgagctcccactgttgtgggtgtctcagctctgagggtctttgtgagttcccaccaacttttaattattcatgcccttgaccatgtggttgcttggagacctggggtcttctgcagactgaagaagacacatttctagattatttgtcctttttatcctctcaaaaatttaaacactgtacctcttcagtggtcagaagaaagttggaaacttttcctacatattaggcgttagtatgaggacatttgtttgaattatagaaatttgccctgagctgaactgggttgtgttaacacattggtagagctatgattccttcccagttctaagagatacgatctgtaagtccctatgtcaccacattgcttgagatgatcattcagttacttgtcaggatttctcctcttcagagagatttttttttatagcacagattcctttgccccttttatctccttatctggatatgataagtggttatgagggtctcactaactattttgtgtttaccttttatatgtgtaaaactttgcagtagcatttaaagtgtaatttatttttctatcaagtgcactattcatttagtgtgttccagttttatatgacttgtattagaaacactgcactgagttgtttgtacactgaaatgagaactctagatgtaactctattcaaataaaccttcgtgagacattca

SEQ ID NO: 9756 - DNA, 1777 bp, Homo sapiens
tttctcggcgtctaccgaggagccgcccctttctcagccttgctcggctcttccccgctctggtcgccggggctgcgccgtccccagctcagtgacaaaaatgctgagtttcttccgtagaacactagggcgtcggtctatgcgtaaacatgcagagaaggaacgactccgagaagcacaacgcgccgccacacatattcctgcagctggagattctaagtccatcatcacgtgtcgggtgtcccttctggatggtactgatgttagtgtggacttgccaaaaaaagccaaaggacaagagttgtttgatcagattatgtaccacctggacctgattgaaagcgactattttggtctgagatttatggattcagcacaagtagcacattggttggatggtacaaaaagcatcaaaaagcaagtaaaaattggttcaccctattgtctgcatcttcgagttaagttttattcctcagaaccaaataaccttcgtgaggagctaacccggtatttatttgttcttcagttaaaacaagatattctcagtggaaaattagactgtccctttgatacagcagtgcaattggcagcttataatctgcaagctgaacttggtgactatgatcttgctgagcatagtcctgaacttgtctcagagttcagattcgtgcctattcagactgaagagatggaactggctatttttgagaaatggaaggaatacagaggtcaaacaccagcacaggctgaaaccaattatctgaataaagccaaatggctagaaatgtatggggttgatatgcatgtggtcaaggctagagatgggaatgactatagtttgggactaacaccaacaggagtccttgtttttgaaggagataccaaaattggcttatttttttggccgaagataaccagattggattttaagaagaataaattaaccttggtggttgtagaagatgatgatcagggcaaagaacaggaacatacatttgtctttagactggatcatccaaaagcatgcaaacatttatggaaatgtgctgtggagcatcatgctttcttccgccttcgaggccccgtccaaaagagttctcatcgatcaggatttattcgactaggatcacgatttagatatagtgggaaaacagagtatcagaccacaaaaaccaataaagcaagaagatcaacatcctttgaaagaaggcccagcaaacgatattctagacgaactctacaaatgaaagcatgtgctacaaaacctgaagaacttagtgttcacaataatgtttcgacccaaagtaatggctcccaacaggcttgggggatgagatctgctctgcctgtgagtccttccatttcctctgctcctgtgccagtggagatagagaatcttccacagagtcctggaacagaccagcatgacaggaaatggctctctgctgccagcgactgctgtcaacgtggtggaaaccagtggaacacaagggccttgcccccaccccagaccgcacatagaaactacactgactttgttcatgagcacaatgtgaagaatgcaggaatccgtcatgatgttcattttcctggccatacagccatgactgagatatgagtgttgagcctcttaggctttgggactctttgtcatgcaagttgatggtatacattatctggtgtttataaaggattaatcacattaggagtatttgggagaatttacagtgagtcactagttgttcagtgctgtttgtaattgaattcttccatgaaa

SEQ ID NO: 9757 - DNA, 2872 bp, Homo sapiens
gtaagcgcgaggcccggcggcggcgccgcagtacagtccgctgcgctcctagccgagtggacccttcctcgcccgcgcctgcggtagcggccttgtccccggggaggcgggcgggggccgcacccagaccctagggcggccggcccctctctcgtcgggccggcagggcattaatcccgccggagggaggggcggcggcggccaatgaggcagggccgccgagtttcggtcgataccgcgcgacgggccggggcggagggcccggggcagccgggttaatgtttgccgagcggacgcgctccccgagccgcgggtacccctcgctggtccgctgggctgccgtccagcgggagagacaaaagtcgcaagggaaggggaaaaacgaactgagtttgtgtcactgtcttggtggacttttcgagctaacctgtatttgagaaaaacttcagtctcttgggaaaggagaggcagtgacaaaaatgctgagtttcttccgtagaacactagggcgtcggtctatgcgtaaacatgcagagaaggaacgactccgagaagcacaacgcgccgccacacatattcctgcagctggagattctaagtccatcatcacgtgtcgggtgtcccttctggatggtactgatgttagtgtggacttgccaaaaaaagccaaaggacaagagttgtttgatcagattatgtaccacctggacctgattgaaagcgactattttggtctgagatttatggattcagcacaagtagcacattggttggatggtacaaaaagcatcaaaaagcaagtaaaaattggttcaccctattgtctgcatcttcgagttaagttttattcctcagaaccaaataaccttcgtgaggagctaacccggtatttatttgttcttcagttaaaacaagatattctcagtggaaaattagactgtccctttgatacagcagtgcaattggcagcttataatctgcaagctgaacttggtgactatgatcttgctgagcatagtcctgaacttgtctcagagttcagattcgtgcctattcagactgaagagatggaactggctatttttgagaaatggaaggaatacagaggtcaaacaccagcacaggctgaaaccaattatctgaataaagccaaatggctagaaatgtatggggttgatatgcatgtggtcaaggctagagatgggaatgactatagtttgggactaacaccaacaggagtccttgtttttgaaggagataccaaaattggcttatttttttggccgaagataaccagattggattttaagaagaataaattaaccttggtggttgtagaagatgatgatcagggcaaagaacaggaacatacatttgtctttagactggatcatccaaaagcatgcaaacatttatggaaatgtgctgtggagcatcatgctttcttccgccttcgaggccccgtccaaaagagttctcatcgatcaggatttattcgactaggatcacgatttagatatagtgggaaaacagagtatcagaccacaaaaaccaataaagcaagaagatcaacatcctttgaaagaaggcccagcaaacgatattctagacgaactctacaaatgaaagcatgtgctacaaaacctgaagaacttagtgttcacaataatgtttcgacccaaagtaatggctcccaacaggcttgggggatgagatctgctctgcctgtgagtccttccatttcctctgctcctgtgccagtggagatagagaatcttccacagagtcctggaacagaccagcatgacaggaaatggctctctgctgccagcgactgctgtcaacgtggtggaaaccagtggaacacaagggccttgcccccaccccagaccgcacatagaaactacactgactttgttcatgagcacaatgtgaagaatgcaggaatccgtcatgatgttcattttcctggccatacagccatgactgagatatgagtgttgagcctcttaggctttgggactctttgtcatgcaagttgatggtatacattatctggtgtttataaaggattaatcacattaggagtatttgggagaatttacagtgagtcactagttgttcagtgctgtttgtaattgaattcttccatgaaagggacaaggaatcaaggaagccatatagcatcaatgataatgacaaatgtttgtgttgaaaagagtgtgtataccattgtggttttggaagagttttcagaccttagtatgttcacacatcaccagactgtatctcaggagaaggtttgtgtttgtgaacaaggtgcccattattcccccaccacatgccatccaaagagatcgaggttaaaagaatcagacacactaaaaacacagtggaagcatgtctaggcataatatatcagccttttgagatatttattaaaaacttgttcttatacactattttaatatgtctaaagtgacacataccttaatttaagtgcctaagattttaattaatataatttttaattacaaacacttttactttttaataaacacgaatattttaacttaccaaaagatttagagatcacattaataatgtggctcatgtatagagaaatctgaatggttagttttgaatggttaactgattaacattcagttatcataacagttaaccagtggttaactgaatggttacattactactgaatggttctataaaatgaaaaacatatttactttgtcttttcatttgactggcttttctctttcatctcatacacctgacagattacccaggtttgcaacagtctcataatctgatcctgtataacctttaaaataaaattctgaagccaaaacca

SEQ ID NO: 9758 - DNA, 3167 bp, Homo sapiens
gtcctccggggattagagccggtgggctcgttgtgggcgccatttctcggcgtctaccgaggagccgcccctttctcagccttgctcggctcttccccgctctggtcgccggggctgcgccgtccccagctcagtgacaaaaatgctgagtttcttccgtagaacactagggcgtcggtctatgcgtaaacatgcagagaaggaacgactccgagaagcacaacgcgccgccacacatattcctgcagctggagattctaagtccatcatcacgtgtcgggtgtcccttctggatggtactgatgttagtgtggacttgccaaaaaaagccaaaggacaagagttgtttgatcagattatgtaccacctggacctgattgaaagcgactattttggtctgagatttatggattcagcacaagtagcacattggttggatggtacaaaaagcatcaaaaagcaagtaaaaattggttcaccctattgtctgcatcttcgagttaagttttattcctcagaaccaaataaccttcgtgaggagctaacccggtatttatttgttcttcagttaaaacaagatattctcagtggaaaattagactgtccctttgatacagcagtgcaattggcagcttataatctgcaagctgaacttggtgactatgatcttgctgagcatagtcctgaacttgtctcagagttcagattcgtgcctattcagactgaagagatggaactggctatttttgagaaatggaaggaatacagaggtcaaacaccagcacaggctgaaaccaattatctgaataaagccaaatggctagaaatgtatggggttgatatgcatgtggtcaaggctagagatgggaatgactatagtttgggactaacaccaacaggagtccttgtttttgaaggagataccaaaattggcttatttttttggccgaagataaccagattggattttaagaagaataaattaaccttggtggttgtagaagatgatgatcagggcaaagaacaggaacatacatttgtctttagactggatcatccaaaagcatgcaaacatttatggaaatgtgctgtggagcatcatgctttcttccgccttcgaggccccgtccaaaagagttctcatcgatcaggatttattcgactaggatcacgatttagatatagtgggaaaacagagtatcagaccacaaaaaccaataaagcaagaagatcaacatcctttgaaagaaggcccagcaaacgatattctagacgaactctacaaatgaaagcatgtgctacaaaacctgaagaacttagtgttcacaataatgtttcgacccaaagtaatggctcccaacaggcttgggggatgagatctgctctgcctgtgagtccttccatttcctctgctcctgtgccagtggagatagagaatcttccacagagtcctggaacagaccagcatgacaggaaatgcattcctctgaatattgatttgctgaatagcccagacttattggaagcaacgattggtgatgtaattggggcatctgacactatggaaacatcccaagcactgaatgacgttaatgtagccaccaggcttccgggattaggggaacctgaagttgaatatgagacattaaaagacacctcagagaagctcaaacagcttgagatggagaacagtcctttgctgtcccctcgatccaacatcgatgttaacataaacagccaggaggaagtggtgaagttgactgagaaatgccttaataatgtcattgagagcccaggattgaatgtcatgagagttcctcctgacttcaagagtaacattttgaaggctcaagtagaagcagtgcataaggttacaaaagaagatagcttattaagtcataaaaatgccaatgttcaggatgctgccacaaacagtgctgtgttaaatgagaataatgtgcccctccccaaagagtctcttgagactctgatgcttatcacacctgccgacagtggttctgttctaaaggaagctacagatgaattggatgccttgcttgcatctctaactgagaatctaattgatcacacagttgcacctcaggtgtcttccacatccatgatcacaccccggtggattgttccgctctggtcccattttggcagaagaagctgtcctgaagcagaagtgtttactgaccactgagctctgagggcctgtagctggaatacgcatctctccagcattccgtcctgggatccgtttcagctagaatatgttggattcaggagcttgtccattatttgtaggtaaaaaaagctgcacgtagatttgacttcaactccgtaaaaaagacagctgtattttccgtccaactggaattgttgaatcacactgcatagctgcccaaaagagagtgtttggtcttgaactttctatacttttataaatgttacaaattcccgaaagaagggaatttctttttctggggtttccttcaaactcttggctccacctagcggttctatttgttcataacaacttcataacaagcctgcctctggtagtcaacagccttttgaaagctatttccatctagtatcagggtgagagcatccttgatctggctgcctgttagagaaattgcacttttcctgacttacctagaaatcaagaatttaggaaattaatgtggacactataaaggcagacttagggccaacttttttttttttttacaattattacaacactaaagagaagtttagaatatagagagtttttaaatgtctcccattcttttgatttcttactgtactggctatcttaatatttcaagtttacatcaagataaaccctgagaagaactacggagaaatcaaataaaatcctgtcatatttttttcaccctgcctttccacaggaagcactcacaggcaccacacacgtatcatgtaacttatcagtggggtgggttactgttgaagagaccctggggcatttacctcaggcatctgcactcctccgagcccggtggagaatgcaggctgctgtagtctcaggtaatgaaggcacagcacagcagtactccacattgtttcctatttggacatagacttcatttcctttcagtataagctgaataaatttagagctttcaaactgg

SEQ ID NO: 9759 - DNA, 6410 bp, Homo sapiens
atgctgagtttcttccgtagaacactagggcgtcggtctatgcgtaaacatgcagagaaggaacgactccgagaagcacaacgcgccgccacacatattcctgcagctggagattctaagtccatcatcacgtgtcgggtgtcccttctggatggtactgatgttagtgtggacttgccaaaaaaagccaaaggacaagagttgtttgatcagattatgtaccacctggacctgattgaaagcgactattttggtctgagatttatggattcagcacaagtagcacattggttggatggtacaaaaagcatcaaaaagcaagtaaaaattggttcaccctattgtctgcatcttcgagttaagttttattcctcagaaccaaataaccttcgtgaggagctaacccggtatttatttgttcttcagttaaaacaagatattctcagtggaaaattagactgtccctttgatacagcagtgcaattggcagcttataatctgcaagctgaacttggtgactatgatcttgctgagcatagtcctgaacttgtctcagagttcagattcgtgcctattcagactgaagagatggaactggctatttttgagaaatggaaggaatacagaggtcaaacaccagcacaggctgaaaccaattatctgaataaagccaaatggctagaaatgtatggggttgatatgcatgtggtcaaggctagagatgggaatgactatagtttgggactaacaccaacaggagtccttgtttttgaaggagataccaaaattggcttatttttttggccgaagataaccagattggattttaagaagaataaattaaccttggtggttgtagaagatgatgatcagggcaaagaacaggaacatacatttgtctttagactggatcatccaaaagcatgcaaacatttatggaaatgtgctgtggagcatcatgctttcttccgccttcgaggccccgtccaaaagagttctcatcgatcaggatttattcgactaggatcacgatttagatatagtgggaaaacagagtatcagaccacaaaaaccaataaagcaagaagatcaacatcctttgaaagaaggcccagcaaacgatattctagacgaactctacaaatgaaagcatgtgctacaaaacctgaagaacttagtgttcacaataatgtttcgacccaaagtaatggctcccaacaggcttgggggatgagatctgctctgcctgtgagtccttccatttcctctgctcctgtgccagtggagatagagaatcttccacagagtcctggaacagaccagcatgacaggaaatgcattcctctgaatattgatttgctgaatagcccagacttattggaagcaacgattggtgatgtaattggggcatctgacactatggaaacatcccaagcactgaatgacgttaatgtagccaccaggcttccgggattaggggaacctgaagttgaatatgagacattaaaagacacctcagagaagctcaaacagcttgagatggagaacagtcctttgctgtcccctcgatccaacatcgatgttaacataaacagccaggaggaagtggtgaagttgactgagaaatgccttaataatgtcattgagagcccaggattgaatgtcatgagagttcctcctgacttcaagagtaacattttgaaggctcaagtagaagcagtgcataaggttacaaaagaagatagcttattaagtcataaaaatgccaatgttcaggatgctgccacaaacagtgctgtgttaaatgagaataatgtgcccctccccaaagagtctcttgagactctgatgcttatcacacctgccgacagtggttctgttctaaaggaagctacagatgaattggatgccttgcttgcatctctaactgagaatctaattgatcacacagttgcacctcaggtgtcttccacatccatgatcacaccccggtggattgttccgagtggtgccatgtctaatggacttgcgggatgtgaaatgcttttgacagggaaggagggacatggtaataaagatggaatctcactgatctctcccccagcgccattcttggtagatgctgtgaccagctctggtcccattttggcagaagaagctgtcctgaagcagaagtgtttactgaccactgagctctgagggcctgtagctggaatacgcatctctccagcattccgtcctgggatccgtttcagctagaatatgttggattcaggagcttgtccattatttgtaggtaaaaaaagctgcacgtagatttgacttcaactccgtaaaaaagacagctgtattttccgtccaactggaattgttgaatcacactgcatagctgcccaaaagagagtgtttggtcttgaactttctatacttttataaatgttacaaattcccgaaagaagggaatttctttttctggggtttccttcaaactcttggctccacctagcggttctatttgttcataacaacttcataacaagcctgcctctggtagtcaacagccttttgaaagctatttccatctagtatcagggtgagagcatccttgatctggctgcctgttagagaaattgcacttttcctgacttacctagaaatcaagaatttaggaaattaatgtggacactataaaggcagacttagggccaacttttttttttttttacaattattacaacactaaagagaagtttagaatatagagagtttttaaatgtctcccattcttttgatttcttactgtactggctatcttaatatttcaagtttacatcaagataaaccctgagaagaactacggagaaatcaaataaaatcctgtcatatttttttcaccctgcctttccacaggaagcactcacaggcaccacacacgtatcatgtaacttatcagtggggtgggttactgttgaagagaccctggggcatttacctcaggcatctgcactcctccgagcccggtggagaatgcaggctgctgtagtctcaggtaatgaaggcacagcacagcagtactccacattgtttcctatttggacatagacttcatttcctttcagtataagctgaataaatttagagctttcaaactggaaaaaaaaatgaaacaaaacaaatacaccaagaccaaaataggcaataggaacaggggtgaagggatgttgtttcttaaatacctaccatgtatgaagctatacacagcatataccgaaagaacctgcattgcactaggaattctgtgttagtttaaaagagatctctaaaacttccccatccctttgggcctgtacaaagaaattctggatgttaaaataatatatactcatcacagaaaaataaagtatagcaatgtccatctgtaattctaatacccagaaataacgctatttagctttataattttcgaatgaacaaggtaaacctcggttgccatggggaagaaggatgatgtggaaaccatattggtaaagttgttaatccctcgttatggagaactgatcttaagctatacctcctggaatttgctttctagttttctgtcctgcaatatgtatataattaagcactaatttgtactgcttagcataaaagaacatccagtcttagatccttaaaacttcatggattggactttcctgggctccttataacataatcgtgtgtccaggcaaacgcacactagtgtctgactggaaagctcaggaattttaatcttgcactgtttcccagggagctgtagtgattggaacccacgtttgcacaaaacatttttgcagaaggaaagtcaacacttcttgctggctgcctccccttagccattatgctaaaaacagcttctgagtttcactggtggggctcttgccagttcttaattataggacatattttctcaaagctgaaggtgacacctagaaccaggggcttgacccaggacatgatggaatgagcatcaaattttcagtgtcttggcaaccgtagatgtcctacagggttaccgttgtgctgctcaccacagagcagctgaggcattatgccttggaagacctaaatctcccatccagttcaggaggtgacaacatccttattttaaacttcctaaaattaggaattaggtagttggacatagtctgtgacctttatgtcgttggatacctgtattcttgacagttagaatattggtagggactttgttaaaattcacttgaatttcaagctcagaggaaactttgtctcatgccctgacatgaagtggcaaacacggaagttcatacttgaatgctgaattggccccgacagattaaatgcgtgttggggattggtttcctgtcatagctgctgctgctgccatgcgcagagctgctgtaacagctcttcctgttctgctcccctgagaacagtgtggtggggagaggcagggctgaggtggtctacgaatgtggcaggtagggaaggggagatgtctgtctcttgagaagagagaggcatgtgtgccggcatccttgatgggttcaaagagaaaggttggagatgatagtgggtgagaagcaggctggtgagactgggctgaggttggagaaggggcagccgggggcactgctgagggtttgccgtgcacgcctcggacggagcacggtggggtggcggggagcagatagtgctgcctccctgcgggcagacaggagaggaacctcaactcagtccatttcatagccctgataggggaagtgggagttgacaggatggtttaaaataagacgtgaaggtttcagttacctgctctagactttgcctgagaacttgtaaattaatcagtgagacctaatttgtgacatgtcagtagcatcatcttttgacacacaggaggtcatggtcatttcattcctactcttcaggagacactgctgaacagaggaatgattctgttccttgtgtgcttacttccttaacatttatacattgttttaagaaaaaacttttaaaaatatttcttatagtctcctaacatttgtctctagcctttgcctttgtacaatcacagatatcctatggagatttaaggatgaaagccctgagttgttcttgggttcttggatctggactacttgttatcttatgcttctcacttctggctaaaacttgcacctcttcttctcttagctaagccccaaaatgaagatttccttcagaagtcttgttagcagaattatttatcagtcacagagagaaaaatctgctatttttctaagtaagagtctcgagaagcagagtttttgtcttgtcattgagaggagtcagcagtcttgttctgtaaaggaccagagatggtaaatactgtcccactcagctctgctggcgcagtacagcagcagcagccccagcacagctgtgttcctgcggagtcccctttacaaagccgctgacccctgatgtgaaactttgtagagcagcagagtggctgcgtgaaacgggaggctggcaggtcctcagataggttctgcagtgttacctgtcacttggaggcagccaacacttctggacattgcatccttattcacacatgtggcagctgaacgaggtgctgttgtgggtgtctcagctctgagggtctttgtgagctcccactgttgtgggtgtctcagctctgagggtctttgtgagctcccactgttgtgggtgtctcagctctgagggtctttgtgagttcccaccaacttttaattattcatgcccttgaccatgtggttgcttggagacctggggtcttctgcagactgaagaagacacatttctagattatttgtcctttttatcctctcaaaaatttaaacactgtacctcttcagtggtcagaagaaagttggaaacttttcctacatattaggcgttagtatgaggacatttgtttgaattatagaaatttgccctgagctgaactgggttgtgttaacacattggtagagctatgattccttcccagttctaagagatacgatctgtaagtccctatgtcaccacattgcttgagatgatcattcagttacttgtcaggatttctcctcttcagagagatttttttttatagcacagattcctttgccccttttatctccttatctggatatgataagtggttatgagggtctcactaactattttgtgtttaccttttatatgtgtaaaactttgcagtagcatttaaagtgtaatttatttttctatcaagtgcactattcatttagtgtgttccagttttatatgacttgtattagaaacactgcactgagttgtttgtacactgaaatgagaactctagatgtaactctattcaaataaaccttcgtgagacattc

SEQ ID NO: 9760 - DNA, 3514 bp, Homo sapiens
cagaattgttgggcttcatcttggctctgtgctgcctggaggggagacctaggataggctcctgatctgcaaaatggggataatcccagctgccacttaagtgagacaagtgcctgactgacagaagttcttgcccccggggagctggtgtggacagaggagggagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctga

SEQ ID NO: 9761 - DNA, 6266 bp, Homo sapiens
catcagcgggcgggggtgtcgccgaacaggctgctccgcagagcccgccgcgaccccgcgccgccccgccccgcggcctgcctgccagaggagccgagggggccgcccctcgcccaacctgcccgacatggggaaccccgggcccaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagccggagcaggaaaccacgccgagacacaagcaggagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccagcaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 9762 - DNA, 8421 bp, Homo sapiens
agtcggcatccatcagcgggcgggggtgtcgccgaacaggctgctccgcagagcccgccgcgaccccgcgccgccccgccccgcggcctgcctgccagaggagccgagggggccgcccctcgcccaacctgcccgacatggggaaccccgggcccaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagccggagcaggaaaccacgccgagacacaagcaggagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagtcccagaggacccaggacatctctcagcgggacttggtacctgagcctggagcagccgcaggcttggaagtgttcactcagaaaagcctcgcagcatctcctgagggttcagagcattgggtatttatagaaagagagtacactaggccagaagagctcggtctcctaaaagtgaccaccatgcagcaggaagaaaggcaggcaggccttgctggtatccttgccaacggcagactctccaaggtagacgttctggtggacaagttcaaagtggaagtggccacagaagaaatggtgggaaacagaagagcaaacacccagcaacaaggaaaaatgattgcaagtcctgaagactttgagtcagtgggggaggaaggcccctggatcagggaaagcccaggaggggctgccctggcttccggccgcacattggcagaaaagctcctcgagggctctgagctcagggcagacaccagagaggcaaccatcaggaaccgctgcatgtcagatggtcagccggagggccagacagagctgaggaaggggctggaggagcctcacacttgtgggagacccactgctccagggaccaggccagcagaggtggacgtcctctctccagcctccgacaagggaggactccagtcgtttctattggatccagcccacgcagaagccagagctgagttgagcaatgaaactgatacttcctttgcagagaggagcttctatttaaattatgaagaaaaagactcagaagaccaagtcctccctccacccctggaggagagaaaagggcgcctggatgcccctcccggaggtgagcccaggccgacgctgaattccttagacctgagggtttctgctgctgcttccagcaggagcaaggacgaagcccacatgacttccccaaaggaaggggcagggacccccaagaaccatggaggacctggtgacctgaagggatctcccgcaggacagacgtttgctgaaggctgggaagatgcccagtggggagtggaaggagagtttccccacctgacagccagcgcagcccgagaggaagggacccccgtgagtggagatttgctgggaaaggctgaggaaagtcccacagaggaactgaagaagcaccctcctcacagaggacagggcgtgcatcccgacccccaggcctgcgcccttcctcgggccatccctctgaatgtcaggaagccagtcaaaccagacagaggcaacttcccacccaaagagaggggagtggttcccacccagaaaggaggggctgagctgaaggaccgcgaggcttcagcatttcttcacatggaggtgatcattcccctgccagcctcccctggtcattctgaggacctggcagctctggaggaagcttctccaagcccaacctcccatgggtcaggggagccttcggagctcagggagccctttcttagacatgtccatctttcgaaagccagcccagagcccaaggaccaagtagggtttgtggtgtcccctgccacaggaggtgagcgcaggcctcctcccatcaccagcagaaagcccagagtagtccctgaagaagctgaggggcgcatacctctggggtttgggttcccttcagggaagcgaagggagatgacctctttccaggctggggaccaagagggctccctagaagatattagcaagacctcagtggccaacaaaattcggatatttgagacccacggagctgaaactcgccgaatgagtgagggtgaagcaaggtcccttccaaatgacgtatcttcagaggcacccgtgggacaagcagagcagcagcggagtacgctctcagacctgggcttcgcccaactccagcccccaggggactttgccagccccaaagccacacattccacagtgatacctctggctaccagacacttcagggaggacacttctgcatcctaccaggaagcacacacggaactagagcccgtgtcccccaattcaggctgtgaaaccacgctggcagaagctactggaactgggaacaaatccggagatgcggtcagggaagagaagcgctccaccaacttagcagccaacacccctgggaagggggggcgcctgagatttgccagcccctcgggccctcagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccagcaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 9763 - DNA, 2652 bp, Homo sapiens
ctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagccggagcaggaaaccacgccgagacacaagcaggagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctga

SEQ ID NO: 9764 - DNA, 763 bp, Homo sapiens
tcggcatccatcagcgggcgggggtgtcgccgaacaggctgctccgcagagcccgccgcgaccccgcgccgccccgccccgcggcctgcctgccagaggagccgagggggccgcccctcgcccaacctgcccgacatggggaaccccgggcccagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatag

SEQ ID NO: 9765 - DNA, 5565 bp, Homo sapiens
atggttttcttggggaggatcaatgaggtagaacctgcaaagggcttagcagagagcctagcacctactgagcgctcagtaaagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagcccgtgaaaacagaaaccatgactgtcagcagtctggccattagaaagaagattgagccggaggccgtactgcagaccagagtctccgctatggataacacccagcaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 9766 - DNA, 3631 bp, Homo sapiens
gcatttctgcgcagctctagcgcgcctcggagcccgccggggcagccgccggacaccaggaccgcgagccagacagctcccggaagccgcgccgccgccgccaggtgcctgactgacagaagttcttgcccccggggagctggtgtggacagaggaggggccctggaagtgaccactgggctgagtagctcatcagcttccccacactgaagcccgaggggtctcctgctggcttctgagagctgacggaacaggttccagcaaggcagaccctgacacagaagccagacctgtccagcagggaccccatacactgagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccagcaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggt

SEQ ID NO: 9767 - DNA, 3126 bp, Homo sapiens
gcatttctgcgcagctctagcgcgcctcggagcccgccggggcagccgccggacaccaggaccgcgagccagacagctcccggaagccgcgccgccgccgccaggtgcctgactgacagaagttcttgcccccggggagctggtgtggacagaggaggggccctggaagtgaccactgggctgagtagctcatcagcttccccacactgaagcccgaggggtctcctgctggcttctgagagctgacggaacaggttccagcaaggcagaccctgacacagaagccagacctgtccagcagggaccccatacactgagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccagcaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaaaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggt

SEQ ID NO: 9768 - DNA, 3840 bp, Homo sapiens
cgcctcggagcccgccggggcagccgccggacaccaggaccgcgagccagacagctcccggaagccgcgccgccgccgccagccacagcacagccggacagaggaggtggattaggagttcccgggagggagcctgctcagcctttccctgacatttgggcaaatgtgtggggagatgcggagctcaaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagccggagcaggaaaccacgccgagacacaagcaggagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggttgatgggagtgcctcagtggggagggagttcatagcaaccactccctccatcaccacggagaccatatcgaccaccatggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatg

SEQ ID NO: 9769 - DNA, 2677 bp, Homo sapiens
gcatttctgcgcagctctagcgcgcctcggagcccgccggggcagccgccggacaccaggaccgcgagccagacagctcccggaagccgcgccgccgccgccaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagccggagcaggaaaccacgccgagacacaagcaggagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggagaacagtctcaagtccgggaagggggcagctgccatgatcccaggcccacagacggtggccacggaaatccgttctctttctccgtctgcagatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccaca

SEQ ID NO: 9770 - DNA, 652 bp, Homo sapiens
agagcaggagcgagcgcgcgagagagcggggcatttctgcgcagctctagcgcgcctcggagcccgccggggcagccgccggacaccaggaccgcgagccagacagctcccggaagccgcgccgccgccgccaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaat

SEQ ID NO: 9771 - DNA, 460 bp, Homo sapiens
tctcctgctggcttctgagagctgacggaacaggttccagcaaggcagaccctgacacagaagccagacctgtccagcagggaccccatacactgggaggcttcctgggaaactggaaggcagaagccacgcagacttctagtcctggttccactgcttactcggctgctgttcgtacctgcctcatggttttcttggggaggatcaatgaggtagaacctgcaaagggcttagcagagagcctagcacctactgagcgctcagtaaaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacag

SEQ ID NO: 9772 - DNA, 896 bp, Homo sapiens
cgagagagcggggcatttctgcgcagctctagcgcgcctcggagcccgccggggcagccgccggacaccaggaccgcgagccagacagctcccggaagccgcgccgccgccgccagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgcttt

SEQ ID NO: 9773 - DNA, 210 bp, Homo sapiens
ctttcagatgctatcttgggctcgctgaacacgggtgcctgactgacagaagttcttgcccccggggagctggtgtggacagaggagggagcctagacatggaggagaaggactacagtgaggccgatggcctttcggagaggaccacgcccagcaaggcccagaaatcgccccagaagattgccaagaaatacaagagtgccatctgcc

SEQ ID NO: 9774 - DNA, 864 bp, Homo sapiens
cctcagtggggagggagttcatagcaaccactccctccatcaccacggagaccatatcgaccaccatgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgc

SEQ ID NO: 9775 - DNA, 5863 bp, Homo sapiens
gtgcctgactgacagaagttcttgcccccggggagctggtgtggacagaggagggagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaagatactacctgtgcctgcagctgcgggcagacatcatcacgggccggctgccatgctcctttgtcacgcatgccctactgggctcctacgctgtgcaggctgagctgggtgactatgatgctgaggagcatgtgggcaactatgtcagcgagctccgcttcgcccctaaccagacccgggagctggaggagaggatcatggagctgcataagacatatagggggatgaccccgggagaagcagaaatccacttcttagagaatgccaagaagctttccatgtacggagtagacctgcaccatgccaaggactctgagggcatcgacatcatgttaggcgtttgtgccaatggcctgctcatctaccgggaccggctgagaatcaaccgctttgcctggcccaagatcctcaagatctcctacaagaggagtaacttctatatcaagatccggcctggggagtatgagcaatttgagagcacaattggctttaagctcccaaaccaccggtcagccaagagactgtggaaggtctgcatcgagcatcatacattcttccggctggtgtcccctgagcccccacccaagggcttcctggtgatgggctccaagttccggtacagtgggaggacccaggcacagactcgccaggccagcgccctcattgaccggcctgcacccttctttgagcgttcttccagcaaacggtacaccatgtcccgcagccttgatggagcagagttctcccgcccagcctcggtcagcgagaaccatgatgcagggcctgacggtgacaagcgggatgaggatggcgagtctggggggcaacggtcagaggctgaggagggagaggtcaggactccaaccaagatcaaggagctaaagttcttagacaagccagaagatgtcttgctgaagcaccaggccagcatcaatgagctcaaaaggaccctgaaggagcccaacagcaaactcatccaccgggatcgagactgggaacgggagcgcaggctgccctcctcccccgcctccccctcccccaagggcacccctgagaaagccaatgagagagcagggctgagggagggctccgaggagaaagtcaaaccaccacgtccccgggccccagagagtgacacaggcgatgaggaccaggaccaggagagggacacggtgttcctgaaggacaaccacctggccattgagcgcaagtgctccagcatcacggtcagctctacgtctagcctggaggctgaggtggacttcacggtcattggtgactaccatggcagcgccttcgaagacttctcccgcagcctgcctgagctcgaccgggacaaaagcgactcggacactgagggcctgctgttctcccgggatctcaacaagggggcccccagccaggatgatgagtctgggggcattgaggacagcccggatcgaggggcctgctccaccccggatatgccccagtttgagcccgtgaaaacagaaaccatgactgtcagcagtctggccattagaaagaagattgagccggaggccgtactgcagaccagagtctccgctatggataacacccaggagaacagtctcaagtccgggaagggggcagctgccatgatcccaggcccacagacggtggccacggaaatccgttctctttctccgatcatcgggaaagatgtcctcaccagcacctacggcgccactgcggaaaccctctcaacctccaccaccacccatgtcaccaaaactgtgaaaggagggttttctgagacaaggatcgagaagcgaatcatcattactggggatgaagatgtcgatcaagaccaggccctggctttggccatcaaggaggccaaactgcagcatcctgatatgctggtaaccaaagctgtcgtatacagagaaacagacccatccccagaggagagggacaagaagccacaggaatcctgacctctgtgaagagatcctggcatttctggtccaacccaagccagagaaccattaagaaggggccttcattctggattctccgacgcaacactgacgtcccagctgcgacgtactgtcactgatgagagactgggaagggaaaagcatatatatatagatatatagagatatagatatatatacaggaaacaccgcatccttgcactgctgctggggctggcagagcagttggctgacagcaacaaccgacatctgaacacctacatttcctttgcagacaaattgaagaactggtgggatttttttcaagaaaaaaaattatataataactataatcccttgctcacccctttcccccgccaaataagaaacgcaagccagaccacgatgattgtagaagtccctcccgccctggttctgcacgttacagttagcagacgagcaattccatttgttcttctccagcatctctaaggcccacttgaatgcaaaggaaaacacttgcacagcaaagcaagagaagtcacagcagcaagacacgcacagtcaaccattttccgagaaaaaaagaaaattccccacttggaaagaaagaggaggaacactggattcttactttctggatcttgacactgggctgcaaaacctaccttcctctctcccgcctcccctcaccctcaactctcaatgtcttgctgtcattttctgtctcggctccctcctcccccttcccccttcccccaccccacacccttcaccctctgtgtcctggtccttctgagggccactgcagatgactctcctttgaaatgagaaaaagaaaagaaagcaagaacagaaaacgaagccacaggaagggaagtagacattgtatgcttatggtttctcattatgaaggtgcagcttgtaggaggtttgtacggatgtgctttgaagttatgtatattacatataacaggaaaaaatattaaaataaacagtgctggtaagtatgaagctgacattctaaaattataattatctgactgtgattgatgtatcctgaggttcctagatctcactgaactggcccagctaaggagacctggactctgggtgtgggttggctcacagtaggggctgacgggttcagtgtagtaatactgtgtgtggtgtttgtaattggttgattggtggggaggggtggggggccctaatggagaggtgtgggtttggcaagaaagaagcaacacagatgtcgtccccaaaatgccagttcaagacaccttctccctgcccccctggtagtaacagtcagggcctggtctgtgctcaggtactgggtcccagtctgggactctgctgctgaagttgccacagtagaggtccctggcttagtccttatctccctacggggcttgccttggttttcagtcttctctctctttctctcttttttttttttttgccacattctgcccttccctgaccccattgtaataaccaactccatatccaaagggaggtggtgctctcagccattgtagaagatggtggctttaacctgactgtctaaaaattcccagctaagccttttcctctactctcttccttgttctgaatcatttcttcttctcaggccaaagtagccatggtaaggaggcttcatggggcagaccctgaaagatcaaaactgcatttgcaaagccctcccctgtcccaggacaaagctgagactgacgggtgatgttgctcataggctccagctctgcataagaccttggcttggagacctccctctcagtcaacagctgaactctgagcttgtgcccagaaattaccccaagaccacaggaacccttcaagaagctcccatcacaagcttggcattgctctctgccacacgtgggcttcctcaggcttgtctgccacaagctacttctctgagctcagaaagtgccccttgatgagggaaaatgtcccactgcactgcgaatttctcagttccattttacctcccagtcctccttctaaaccagttaataaattcattccacaagtatttactgattacctgcttgtgccagggactattctcaggctgaagaaggtgggaggggagggcggaacctgaggagccacctgagccagctttatatttcaaccatggctggcccatctgagagcatctccccactctcgccaacctatcggggcatagcccagggatgcccccaggcggcccaggttagatgcgtccctttggcttgtcagtgatgacatacaccttagctgcttagctggtgctggcctgaggcagggcaggaaatcagaatagcatttgcttctctgggcaaatgggaagttcagcggggcagcagaatcagtggcattccccctggtgcaggccggtgggtccactccaactccccctgagtgtagcagcacactttccatacaccaggttctttctacaatcctggtggaaaagccacagaaccttcttcctgcccttcttgagagttccccctctttctgggtcaagagctggagtggtggctccatcctctctgggccacttcggtctaggaactcatctttgcaggaaccaggagtcctgagcacactgaacacacctcagagggaggatccttgttgtggattttgcacctggctttggggcaggggtgaagtgaccaggcttagcttgtggagtttatgggccaccagggtttggggaaatcaccatcccgcggatgctgtgacctcccttctacggagatgcaggcagtgccacgagggaggaggggacctgcaaagctagaatctagggcactgtttcctccccatccttctctttgtagagaatagagacgtttgtcttgtctgtcttcaacctacttttccttttctcttttttgtttctcatcctctctgtgccacctctccacccaggaggccatgtagcatagtggaaaaagtccctgagggcggttaggagttctgggtgaccatcctggctcagctcctaactcaccatgtgacatcaggctatccccattccccctcttgggcctcagtttcccgacttgcaaaataagcagaaagaaccagatgctctccagggtctttttctactttgctatctcatgggtcttcattttctcttattttgttttctctggatcttttccatctgagggtacaggaagtaccaggacctgtttcagtttttgaatcctgcaagcacattccaagactggcctgaaactgcatgagcaacatcactcgaaataattttttttttcaaaagcaccttaacaaccaattgcgatgctgtcctgttcctttttactcacacccttctctcctttctcgtccccatgctcccccacctcagtgctccgtgctgtatgcgtgtgctctctgttcttgtatactcaatataagtgaaataaatgtgtttgatgctgaaccata

SEQ ID NO: 9776 - DNA, 896 bp, Homo sapiens
tccgcgtcccggggaccccgccgcgtcgggtcccgcgtgtgcgtgtggggtggccgccgagggcggcgggctcgattcccgatctttgggcactgacaggccggcgggccggctccaggagccgcgggcttcggtagctccttggatattcctttctgcaagtgatcaggcaaagataaattccattttacagatgaggaagctgaggcctgtgaagggaaagtgacctggctacacagccggaacctgaatgcaggacattctgcccctgtcgtggtggtattggagccagctaatgccaccattcgaggttgcaggagcagcacctgaccagaaatccagagcttgtttaaaggaccctgaaatttgaagactatccacacatatctactttctggatatccacggagagaccatgggctttttcatcaaggaggcctgagttcaaatccttcttctatgtctgattctctctgtgaccttgggtgcctgactgacagaagttcttgcccccggggagctggtgtggacagaggaggggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggag

SEQ ID NO: 9777 - DNA, 769 bp, Homo sapiens
cgcctcggagcccgccggggcagccgccggacaccaggaccgcgagccagacagctcccggaagccgcgccgccgccgccagccacagcacagccggacagaggaggtggattaggagttcccgggagggagcctgctcagcctttccctgacatttgggcaaatgtgtggggagatgcggagctcaaggcgtgctggtcaccatgacaacagagacaggccccgactctgaggtgaagaaagctcaggaggaggccccgcagcagcccgaggctgctgccgctgtgaccacccctgtgacccctgcaggccacggccacccagaggccaactccaatgagaagcatccatcccagcaggacacgcggcctgctgaacagagcctagacatggaggagaaggactacagtgaggccgatggcctttcggagaggaccacgcccagcaaggcccagaaatcgccccagaagattgccaagaaatacaagagtgccatctgccgggtcactctgcttgatgcctcggagtatgagtgtgaggtggagaaacatggccggggccaggtgctgtttgacctggtctgtgaacacctcaacctcctagagaaggactacttcggcctgaccttctgtgatgctgacagccagaagaactggctggacccctccaaggagatcaagaagcagatccggagtagcccctggaattttgccttcacagtcaagttctacccgcctgatcctgcccagctgacagaagacatcacaag

SEQ ID NO: 9778 - DNA, 4613 bp, Homo sapiens
gtcgcgggaggggcttccgccgcgagggggcggggccggccctcagagtcctctgacggccccagtcagggaatttcaatttgaaacctagcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagaaaaggagaccatcttttcaaggatattttatccgtgaaggagaagtacctgatgccgacaatatggacagttgaagaaaaagctcaggagacggacaagacacgtgctcccgagtcagaagggccttgcactggagccagggatgctgttaagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 9779 - DNA, 4457 bp, Homo sapiens
gtcgcgggaggggcttccgccgcgagggggcggggccggccctcagagtcctctgacggccccagtcagggaatttcaatttgaaacctagcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 9780 - DNA, 4456 bp, Homo sapiens
cgggaggggcttccgccgcgagggggcggggccggccctcagagtcctctgacggccccagtcagggaatttcaatttgaaacctagcggagggaggaggcaggcgcggctgccggcggctgggactgaagagggacgggtcccgcggcgagcgagctcctgaggtacggcgtcgggcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaaaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattct

SEQ ID NO: 9781 - DNA, 3369 bp, Homo sapiens
agcggagggaggaggcaggcgcggctgccggcggctgggactgaagagggacgggtcccgcggcgagcgagctcctgagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctct

SEQ ID NO: 9782 - DNA, 3910 bp, Homo sapiens
gaggaggcaggcgcggctgccggcggctgggactgaagagggacgggtcccgcggcgagcgagctcctgaggtacggcgtcgggcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagagttcacatgagactctgaatatagtggaggagaagagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctct

SEQ ID NO: 9783 - DNA, 3677 bp, Homo sapiens
ccgcgagggggcggggccggccctcagagtcctctgacggccccagtcagggaatttcaatttgaaacctagcggagggaggaggcaggcgcggctgccggcggctgggactgaagagggacgggtcccgcggcgagcgagctcctgaggtacggcgtcgggcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 9784 - DNA, 1138 bp, Homo sapiens
cttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagaaaaggagaccatcttttcaaggatattttatccgtgaaggagaagtacctgatgccgacaatatggacagttgaagaaaaagctcaggagacggacaagacacgtgctcccgagtcagaagggccttgcactggagccagggatgctgttaagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagac

SEQ ID NO: 9785 - DNA, 3090 bp, Homo sapiens
agaattccttagtactgttatttctcttgttggaaacccaagtgtgttctagcatctatgaggatgtatctgtaacctttactcctgacatttgtaagtctaatctcaaaagctccttatctccctattattgtagtatttggagaccagatgaattttagctagtttttttttctaaccttaaattatgtaattatatataagagtcactatagggtattttataaggaaggtactattctgttgtctttaacaaatgtatgtgaaaagtgaaacatggctttttgaaaatttagactatataacactaagattgggcctcatagtgctcctttatttaaaattaggtgtttggtttgaggatttttacccctatataaggcaaatttttttcaagtatcctacctctgtgctactaagtcagcattaacatgtacaatatatttttgattattttgttaaatgtggcctggtgatttagtgcctcatattctatggatcctaccaatacatacagtaaatcacaaaatttagagcaaacctaaagaaaaatgtaaagataattgcagtgagtatgcattgtaggacaattgttaaaagtttacctgaggaatgtcaaagatcaacattttagggaattaaatgttgaccaaggagttggaagatgtttcttaacagattattgaatgtctgtgtctcatttttcacatctgataaagactctgagctccttgcttacctctgaaaaatactatgaatggttaaaaaggtaagccgtttgaactctcagatttgacactatcatcctaattaagaaggaaaaggatatatattaggaattaacctataaaggttaaatgatttgcctttgataagggagtcaatatttttattctcaccattttttcccttgagtcaaaattcagtcagtatttgttagttttaaacttctacattcattcttttgaatcatcagatattgagaaatgtccaactatgaaaaactgttcttatttaaagaattttatgtaagtggttatatttcaaagattatttttaaatacccaccattttaatatgaaactagttaaataagccaatccccctcccccagccagaaaagaaatccatatttaacaaactgaatcataggttgaacatttgttccccaatataaagctaaaaacgaattttacatcattatactttaccccatcactagttgctttagacatttcaaattagaacagattgaattatgccatttttgcactctcatattcttgttcctgagtacaaaatattcaaaagcagagcataatctagggactgagaaagagtgaagcttccatcctccattccacctttgcaaaggatcatttccatcattcgtacaacactgtaggtgaagaaagaccaaagaggcttaatattctgcatcttctgagggcctcacagtaaaggcgaagatggaagaagaggaaacgcagctggaagaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaaggtagtagagagggaggaagcagtgcccgaagccagcccagtcacacaagcaggtgccagtgtaatcacagtagaaacagtgatccaggaaaatgtaggtgcccaaaagatacccggagagaagagtgtacacgaaggcgctcttaagcaagacatgggagaagaagcagaggaagagccacagaaagttaacggagaggtgtcccatgttgacattgatgttttgccacaaattatttgttgttcagagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattc

SEQ ID NO: 9786 - DNA, 2568 bp, Homo sapiens
aatttcaatttgaaacctagcggagggaggaggcaggcgcggctgccggcggctgggactgaagagggacgggtcccgcggcgagcgagctcctgaggtacggcgtcgggcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgact

SEQ ID NO: 9787 - DNA, 552 bp, Homo sapiens
gatgcagacatagcctatttggcagctattttatgatagtggtgaacagcacacaaaactccttcagaccctcccaacataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaaga

SEQ ID NO: 9788 - DNA, 3663 bp, Homo sapiens
actgtacttaaggcgtttatcctaatccaggcgtccttggattgcacggtgccagcaagcaaggtggtaacagtgatcacagcctgggctgcaggtgtgagttctgaggagatctatggtttacccagcgaatttattactgataaatcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 9789 - DNA, 585 bp, Homo sapiens
aaaaacagcaactctaaactggctctggatatgtcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaa

SEQ ID NO: 9790 - DNA, 3914 bp, Homo sapiens
gaggaggcaggcgcggctgccggcggctgggactgaagagggacgggtcccgcggcgagcgagctcctgaggtacggcgtcgggcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagatgcagcctactgaattagtaagtaaggagagagaagagaaggtaaaagaaacacaggaagacaaattagaaggaggagcagcaaaaagggagaccaaggaagtgcagaccaatgagctgaaagcagagaaggcatctcaaaaagtcaccaagaagaccaaaactgtccagtgtaaagtgaccctcttagatggcaccgaatacagctgtgacctggagaaacatgccaagggacaagtgttatttgacaaagtgtgtgaacacctcaatctcttggagaaagactactttggacttttgtttcaggaaagccctgagcagaaaaactggttagatcctgctaaagaaataaagagacaactgagaaaccttccatggctattcacttttaatgtgaagttttatcctcctgatccttctcaattgactgaagatatcaccagatacttcttgtgccttcagctccggcaggacattgcctctggccgcctgccctgctcttttgtgactcatgctctcctgggatcctacaccctgcaggctgaacttggtgactatgacccagaagaacatggcagcatcgacctcagtgaattccagtttgcccctactcagactaaggagctggaagagaaggtggcagagctgcacaaaacccacaggggcttatcgccagcacaagctgattcccagttcttagaaaatgcaaagaggctttccatgtatggtgttgacctacatcatgccaaggactcagaaggtgtggacatcaagctgggcgtgtgtgctaatggacttctcatttacaaagacagactgcgaatcaatcgttttgcttggccgaaaatcttaaaaatttcctataaacgcagtaacttctacattaaagtcagaccggcagagctggaacagtttgagagtaccattggattcaaactgccaaaccaccgggcagcgaaaagactatggaaagtgtgcgtggagcatcatactttctacaggcttgtttctccagagcagccaccaaaagccaagttcctgaccttggggtccaaatttcgctatagtggccgcacccaagcacagacccgccaggccagcaccctcatagataggccagcaccacactttgagcgcacttctagtaaacgggtctccaggagtctagatggagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaagagttcacatgagactctgaatatagtggaggagaagaagcgggcagaggttgggaaagacgaaagagtaatcacagaagaaatgaatggtaaagagatatcacctgggagtggtcctggggagattcgtaaggtggagcctgtgacacaaaaagactccacctccctgtcttctgagagcagcagcagcagcagtgagagtgaggaggaagacgtgggagagtaccgtccccaccaccgagtgaccgagggcaccatcagggaggaacaggagtatgaagaagaggtggaggaagaaccccgcccggcagccaagccaccagtggtaaaaacagagatggtaacaatttctgatgcctcacaaaggacagaaatctccaccaaggaagtccccattgtccaaactgagaccaaaaccatcacatatgagtctccacagattgatggcggggctggtggtgattcgggcacgttactgaccgcacaaaccatcacatctgagtccgtgtcaacaacgacaaccacacacatcaccaagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctctaaa

SEQ ID NO: 9791 - DNA, 565 bp, Homo sapiens
acgcgcggtgcgggtcgggcccgctgtaggctcgcgtccgcgcccccagctgccgcctgcgccgtctgggagctgcggagagggacgcgtgtttcgtgctccgatccttacaattcccacacccaggccatctcaccacagatggcttgttttttctcctcctgcgcctgggggccgagggttgggagcatttttagcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaacccctt

SEQ ID NO: 9792 - DNA, 4360 bp, Homo sapiens
ctgaaatggacttgctttcagacatttcagaggaagacccctttggggaggctgaccagatcacactagacagcttagagcacctttccacaggtgaaatatcggagcagggggattctgaagttgctatgcctgatttggtcttggattctgccatagccccttctcagcctgactgtccttctcccatccatgggaagactcttaaagcagctgacgacagtgattctgagtttggttacttctccttcagtttctccaaatgttttccctccggcttcccctcccttcttgatgaagatggatatcttgctttccccagcctccccaaggtctgggtctccttcctccccgctggtgtgcagcactatgtcccaatcacctccccttcattcattccttcccttatcctcatctttgggctacttctgtctgcttctcagtcagttcctttttctcttgccttttcccttcctctggctctatccctctgctatctggaggctaaagccgcctcctttaatgtttcttatgactgtgacttgaatgacaagctcgaggaagaggaagtagttgctggcatgcctacgtaagctcagtttgtggagtcaacacaatacactttatcttaaacccttcctaatatagagtgtaaatgtgtgcatacatttcaccactgattaccctcaacatagtagtacctgcacattttcacacacacaatattttagtgcatgagaaataagtgtagacacttctccttcattgataccattgaccagttccacacattctaagttaggagcgaaattgtaggattattttacaaatatctagatcaaagtagatttgtaacagaaggtgtgggggaggagggaaggaggagggaacctgtattgcccgtaacaatccatacagggtctctccattttgcaaacagatattaatgctgttcctttaggatgacatctttttgttttgatatagaatttaggatgcagtggacataactgttcctgatgtatattagtagaattccttagtactgttatttctcttgttggaaacccaagtgtgttctagcatctatgaggatgtatctgtaacctttactcctgacatttgtaagtctaatctcaaaagctccttatctccctattattgtagtatttggagaccagatgaattttagctagtttttttttctaaccttaaattatgtaattatatataagagtcactatagggtattttataaggaaggtactattctgttgtctttaacaaatgtatgtgaaaagtgaaacatggctttttgaaaatttagactatataacactaagattgggcctcatagtgctcctttatttaaaattaggtgtttggtttgaggatttttacccctatataaggcaaatttttttcaagtatcctacctctgtgctactaagtcagcattaacatgtacaatatatttttgattattttgttaaatgtggcctggtgatttagtgcctcatattctatggatcctaccaatacatacagtaaatcacaaaatttagagcaaacctaaagaaaaatgtaaagataattgcagtgagtatgcattgtaggacaattgttaaaagtttacctgaggaatgtcaaagatcaacattttagggaattaaatgttgaccaaggagttggaagatgtttcttaacagattattgaatgtctgtgtctcatttttcacatctgataaagactctgagctccttgcttacctctgaaaaatactatgaatggttaaaaaggtaagccgtttgaactctcagatttgacactatcatcctaattaagaaggaaaaggatatatattaggaattaacctataaaggttaaatgatttgcctttgataagggagtcaatatttttattctcaccattttttcccttgagtcaaaattcagtcagtatttgttagttttaaacttctacattcattcttttgaatcatcagatattgagaaatgtccaactatgaaaaactgttcttatttaaagaattttatgtaagtggttatatttcaaagattatttttaaatacccaccattttaatatgaaactagttaaataagccaatccccctcccccagccagaaaagaaatccatatttaacaaactgaatcataggttgaacatttgttccccaatataaagctaaaaacgaattttacatcattatactttaccccatcactagttgctttagacatttcaaattagaacagattgaattatgccatttttgcactctcatattcttgttcctgagtacaaaatattcaaaagcagagcataatctagggactgagaaagagtgaagcttccatcctccattccacctttgcaaaggatcatttccatcattcgtacaacactgtaggtgaagaaagaccaaagaggcttaatattctgcatcttctgagggcctcacagtaaaggcgaagatggaagaagaggaaacgcagctggaagagaaaaattccttgagagtagaaggggataatatttatgtcagacatagcaatttaatgttggaggaactggataaggcccaggaggacatactgaaacatcaggctagcattagtgaactcaagcgcaattttatggaatccacacctgagccgcgccctaatgaatgggaaaaacgacgtatcacacctctgtccctacagacacaagggacacgtgctcccgagtcagaagggccttgcactggagccagggatgctgttaagccaccagtggtaaaaacagagatggtaacaatttctgatgcctcacaaaggacagaaatctccaccaaggaagtccccattgtccaaactgagaccaaaaccatcacatatgagtctccacagactgtaaaaggtggaatttctgaaacaagaattgagaaacgcattgtgatcacaggagatggagatattgatcatgaccaggcactggctcaggcgatcagggaagccagagagcagcaccctgacatgtcggtcacaagagtggtggtacacaaagaaacagagttggctgaggaaggggaagattaagtaagaaagtcattttttaaacaacactcaactttgtgaacccctgaagattttttgaccgttccaagtcttaatgccacaccactattccagcgaatttatgctacaactggtaacaatgaccagaagcctgaagaattaaaatgccaacaccaaacctttccttaccagctctggtctatattgctcccatgcatttaatatattattttgttttataaccacttctaaatattctcagttctttctttttgttgttgttaattaaggggttttggttttgttttctgtttactttgtgtgcaactacctgcttttaatgactcactttgatcaaatgacagtgaacaaagccagcccaagctggtaaggtgctgttcacttgaacaggtgctgttgcgcagaaaggaaactctgtgactaatttagatagtggctttccttcttctggattcttttcattgaattctcacagtaaatatttacggagttttcaaattgcagcaaatatactgtatgagaaaatattaatacagattaaaagcctttcttacatcttgaaaattttctaatatttgagaatttcacagggatgttttttatattggacccttttgactttccagtcctgtgactttctacttttagtagagagtcagaatctctggactggagaataatgaagaagttcactgactgtgcactgtgcttagagaccctgccgcaccacagtgccaatgcttgtcagacacatgcccttcggcagcattccagaacaggagggaagagaaagagaaaactttcttcccttctactaaaagattcaggcagcttaaaaccttagtgctttctttcttaacatacccacatttcaattctttccattatttgaacacttgggtagaactcttgctttgtattaaacctctttgtctacacatgtaaaacttaccttttgttattgagcaggcctatctctttcagatagttttatgattcacacaggtttgaggatgctggggagagggggagggggctgtggtggtgttctgttggttacaagaaagttataccatttaaagctggcaccagagacccgatagggacttattaactatattgaacattttttcctttgcctttgaccctatgtatagttacgatgccagattagatttatagcagcctcaagttgtattaaatgatattttgcttcctgtaatactattataaaataaagtttgtttattctct

SEQ ID NO: 9793 - DNA, 588 bp, Homo sapiens
ttatagctcttattccctttgtagttagctatttaaatgccctgctctcacactgctggagccacattttatacaggtctgtgtcctcagcagctatcagcaagcacaaagcaattcctcatggaatgaatggatctttacaaaacccaaaagtacagtattaaaatcaagatttcatgggcagaggtaatgcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtg

SEQ ID NO: 9794 - DNA, 591 bp, Homo sapiens
gaacttcggcttcatcctgtgacttgctcagatgtctttatgtgatccatagtattgtagaaaaacctcagattcaaatgaaagatatgcataagctgtggccatgactactgaagtaggctctgtgtctgaagtgaagaaggactctagccagttaggaacagatgcaaccaaggaaaaacctaaagaagtagcagaaaatcagcagaatcagtcttccgatccagaggaggaaaaaggttcccagccacctcctgcagctgaaagccaaagtagtctacgccgccagaagagagagaaggaaacatcggagagcaggggtatttctcggttcataccgccatggcttaagaagcaaaagtcatataccttagtagtggccaaagatggaggagataaaaaagagcctacccaagctgttgttgaagaacaggtcttagataaagaggaaccccttccagaagaacagagacaggctaagggtgatgctgaagaaatggctcagaagaaacaagagattaaagttgaagtcaaggaagaaaaaccctcagtgagcaaggaagaaaaaccctcagtgagcaaagtggagat

SEQ ID NO: 9795 - DNA, 4706 bp, Homo sapiens
cgtcgtccgcggagcctgaccctgcgccaggacggaggaggctgtgcccatgtaactgtcctgaagtactgcggtggccccctcccccgcggctgggagggcaggcaggacgaggttggctttcctcgcacggtctctgggcgtgggcccccgccgcagctccgcggagcctcggtgtctcctgcaacagggggcggggggaacagcggcgagcagccctgggctgcggcttcctccccacgcccgagtctcctgcgcaccgccgccgaggacgcgcgcccgagcctagtccccacgccgcggcgcgcccgggctccctgctgatcccagaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaagaattggttggaccctgctaaggaaataaaaaaacaggttcgaagtggtgcttggcacttttcatttaatgtgaaattttatccaccagaccctgcccaactatctgaagatatcaccaggtactacctctgcttgcagttgcgagatgacatcgtgtccggaaggctgccctgctcctttgttaccctggccttgctgggctcctacactgtccagtcagagctcggagactatgacccagatgaatgtgggagcgattacattagtgagttccgctttgcaccaaaccacactaaagaactggaagacaaagtgatcgagctgcacaagagccacagaggaatgacgccagcagaagcagagatgcatttcttggaaaatgccaaaaaattatcaatgtatggggtagatttacatcatgctaaggactcagaaggggtagaaattatgttaggagtttgtgcaagtggtctgttgatatatcgcgaccggctgcgaataaacagatttgcctggcccaaggttctaaagatttcatacaaacggaacaacttttacattaagatccggccgggagagtttgaacaatttgaaagcaccattgggtttaagctgccaaaccatcgagctgccaagcgtttatggaaagtatgtgttgagcatcatacatttttcagactactgttaccagaagcacctcccaagaaattcctaaccttgggttccaagtttcgttatagtggcaggacacaagcgcaaacgagaagagccagtgcgttgatagatcgcccagcaccttactttgaacgctcatccagcaaacgttataccatgtctcgcagcttggatggagaggttggtactggccagtacgccacaacaaaaggcatctctcagaccaacttgatcaccactgtgactccggagaagaaggctgaggaggagcgggacgaggaagaggacaaacggaggaagggggaagaagtcacgcccatctcggccatccggcacgagggaaagtcacctgggcttggcactgactcatgtcccttgtcacccccatccacccattgtgcccccacatctcccacagagctccgtaggaggtgtaaggagaatgactgcaaactgccaggttatgagccgtccagagctgagcacctgcctggagagcccgccttggactctgatggcccagggaggccttacctaggggatcaagatgtggcttttagctacagacagcaaactggcaaggggaccaccctgttctccttctccttgcagctccctgagtcattcccctccctcctagatgatgatggatacctctctttccccaacctttctgaaaccaacctcctgccccagagcttgcagcattacctcccgatccgctcaccgtcccttgtgccctgtttcctcttcatctttttctttctgctgtctgcctccttctcagtgccatacgctctcactctctccttccctctggctctgtgcctctgctacctggagcccaaggcggcctccttgagcgcctccctagacaatgacccgagtgacagttcagaggaagagactgacagtgagcgcacggacaccgcagccgacggggagaccactgccactgagtcggaccaggaggaagatgcagagctcaaggcacaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagactaagcagtcttctggggaaaagctcatggatggctctgaaatcttcagtttattagagtctgcgcgaaaaccaacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttataaggtagtactgattttagcatattaatgcgatttcttccttgttgtttgctttggtctgtgttcaatccagagagcttaaattgtcattattttgggaagaaaacctgtatttttgttagtttacaatattatgaaatttcacttcaggagaaactgctgggcttcctgtggctttgttttcttagttactttttccgtgccgtgtattttttaattgatttttcttcttttacttgaaaagaaagtgttttattttcaaatctggtccatatttacattctagttcagagccaagccttaaactgtacagaatttccactgtaattaaaactatttagtgttagttataaatagccttcaaaaagagagattctccattacacgatcacctgcatcacagcccatggtgaatgtatgtttctgcatagcgaaataaaaatggcaaatgcactgaaagc

SEQ ID NO: 9796 - DNA, 3492 bp, Homo sapiens
gttatttgatttgccttggctgtggggaattctgtgctcagaagcaaggactggagcagtgaagtcattgtcctgcctggtgttgtgacatcactatggctcaaaggaaacaagggtggggcaggcaaaaccagaccatctgaagcatcttgctggctttaaaactttgcctgatcaatcaatgagactcctttctcaagttgaactgcattgcgagaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaagaattggttggaccctgctaaggaaataaaaaaacaggttcgaagtggtgcttggcacttttcatttaatgtgaaattttatccaccagaccctgcccaactatctgaagatatcaccaggtactacctctgcttgcagttgcgagatgacatcgtgtccggaaggctgccctgctcctttgttaccctggccttgctgggctcctacactgtccagtcagagctcggagactatgacccagatgaatgtgggagcgattacattagtgagttccgctttgcaccaaaccacactaaagaactggaagacaaagtgatcgagctgcacaagagccacagaggaatgacgccagcagaagcagagatgcatttcttggaaaatgccaaaaaattatcaatgtatggggtagatttacatcatgctaaggactcagaaggggtagaaattatgttaggagtttgtgcaagtggtctgttgatatatcgcgaccggctgcgaataaacagatttgcctggcccaaggttctaaagatttcatacaaacggaacaacttttacattaagatccggccgggagagtttgaacaatttgaaagcaccattgggtttaagctgccaaaccatcgagctgccaagcgtttatggaaagtatgtgttgagcatcatacatttttcagactactgttaccagaagcacctcccaagaaattcctaaccttgggttccaagtttcgttatagtggcaggacacaagcgcaaacgagaagagccagtgcgttgatagatcgcccagcaccttactttgaacgctcatccagcaaacgttataccatgtctcgcagcttggatggagaggttggtactggccagtacgccacaacaaaaggcatctctcagaccaacttgatcaccactgtgactccggagaagaaggctgaggaggagcgggacgaggaagaggacaaacggaggaagggggaagaagtcacgcccatctcggccatccggcacgagggaaagtcacctgggcttggcactgactcatgtcccttgtcacccccatccacccattgtgcccccacatctcccacagagctccgtaggaggtgtaaggagaatgactgcaaactgccaggttatgagccgtccagagctgagcacctgcctggagagcccgccttggactctgatggcccagggaggccttacctaggggatcaagatgtggcttttagctacagacagcaaactggcaaggggaccaccctgttctccttctccttgcagctccctgagtcattcccctccctcctagatgatgatggatacctctctttccccaacctttctgaaaccaacctcctgccccagagcttgcagcattacctcccgatccgctcaccgtcccttgtgccctgtttcctcttcatctttttctttctgctgtctgcctccttctcagtgccatacgctctcactctctccttccctctggctctgtgcctctgctacctggagcccaaggcggcctccttgagcgcctccctagacaatgacccgagtgacagttcagaggaagagactgacagtgagcgcacggacaccgcagccgacggggagaccactgccactgagtcggaccaggaggaagatgcagagctcaaggcacaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagactaagcagtcttctggggaaaagctcatggatggctctgaaatcttcagtttattagagtctgcgcgaaaaccaacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattga

SEQ ID NO: 9797 - DNA, 2826 bp, Homo sapiens
gttatttgatttgccttggctgtggggaattctgtgctcagaagcaaggactggagcagtgaagtcattgtcctgcctggtgttgtgacatcactatggctcaaaggaaacaagggtggggcaggcaaaaccagaccatctgaagcatcttgctggctttaaaactttgcctgatcaatcaatgagactcctttctcaagttgaactgcattgcgagaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaagaattggttggaccctgctaaggaaataaaaaaacaggttcgaagtggtgcttggcacttttcatttaatgtgaaattttatccaccagaccctgcccaactatctgaagatatcaccaggtactacctctgcttgcagttgcgagatgacatcgtgtccggaaggctgccctgctcctttgttaccctggccttgctgggctcctacactgtccagtcagagctcggagactatgacccagatgaatgtgggagcgattacattagtgagttccgctttgcaccaaaccacactaaagaactggaagacaaagtgatcgagctgcacaagagccacagaggaatgacgccagcagaagcagagatgcatttcttggaaaatgccaaaaaattatcaatgtatggggtagatttacatcatgctaaggactcagaaggggtagaaattatgttaggagtttgtgcaagtggtctgttgatatatcgcgaccggctgcgaataaacagatttgcctggcccaaggttctaaagatttcatacaaacggaacaacttttacattaagatccggccgggagagtttgaacaatttgaaagcaccattgggtttaagctgccaaaccatcgagctgccaagcgtttatggaaagtatgtgttgagcatcatacatttttcagactactgttaccagaagcacctcccaagaaattcctaaccttgggttccaagtttcgttatagtggcaggacacaagcgcaaacgagaagagccagtgcgttgatagatcgcccagcaccttactttgaacgctcatccagcaaacgttataccatgtctcgcagcttggatggagcatcagtgaatgaaaaccatgaaatatacatgaaggattctatgtctgctgcagaggttggtactggccagtacgccacaacaaaaggcatctctcagaccaacttgatcaccactgtgactccggagaagaaggctgaggaggagcgggacgaggaagaggacaaacggaggaagggggaagaagtcacgcccatctcggccatccggcacgagggaaagactgacagtgagcgcacggacaccgcagccgacggggagaccactgccactgaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattga

SEQ ID NO: 9798 - DNA, 1647 bp, Homo sapiens
aagaaggctgaggaggagcgggacgaggaagaggacaaacggaggaagggggaagaagtcacgcccatctcggccatccggcacgagggaaagactgacagtgagcgcacggacaccgcagccgacggggagaccactgccactgaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagaccaaagaagaaacagagatttctgaaaaagttatatttttgcagcaaggaagcgctccattccttgagtctcagactaagcagtcttctggggaaaagctcatggatggctctgaaatcttcagtttattagagtctgcgcgaaaaccaacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaacc

SEQ ID NO: 9799 - DNA, 3771 bp, Homo sapiens
ttcctccccacgcccgagtctcctgcgcaccgccgccgaggacgcgcgcccgagcctagtccccacgccgcggcgcgcccgggctccctgctgatcccagaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaagaattggttggaccctgctaaggaaataaaaaaacaggttcgaagtggtgcttggcacttttcatttaatgtgaaattttatccaccagaccctgcccaactatctgaagatatcaccaggtactacctctgcttgcagttgcgagatgacatcgtgtccggaaggctgccctgctcctttgttaccctggccttgctgggctcctacactgtccagtcagagctcggagactatgacccagatgaatgtgggagcgattacattagtgagttccgctttgcaccaaaccacactaaagaactggaagacaaagtgatcgagctgcacaagagccacagaggaatgacgccagcagaagcagagatgcatttcttggaaaatgccaaaaaattatcaatgtatggggtagatttacatcatgctaaggactcagaaggggtagaaattatgttaggagtttgtgcaagtggtctgttgatatatcgcgaccggctgcgaataaacagatttgcctggcccaaggttctaaagatttcatacaaacggaacaacttttacattaagatccggccgggagagtttgaacaatttgaaagcaccattgggtttaagctgccaaaccatcgagctgccaagcgtttatggaaagtatgtgttgagcatcatacatttttcagactactgttaccagaagcacctcccaagaaattcctaaccttgggttccaagtttcgttatagtggcaggacacaagcgcaaacgagaagagccagtgcgttgatagatcgcccagcaccttactttgaacgctcatccagcaaacgttataccatgtctcgcagcttggatggagcatcagtgaatgaaaaccatgaaatatacatgaaggattctatgtctgctgcagaggttggtactggccagtacgccacaacaaaaggcatctctcagaccaacttgatcaccactgtgactccggagaagaaggctgaggaggagcgggacgaggaagaggacaaacggaggaagggggaagaagtcacgcccatctcggccatccggcacgagggaaagactgacagtgagcgcacggacaccgcagccgacggggagaccactgccactgaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttataaggtagtactgattttagcatattaatgcgatttcttccttgttgtttgctttggtctgtgttcaatccagagagcttaaattgtcattattttgggaagaaaacctgtatttttgttagtttacaatattatgaaatttcacttcaggagaaactgctgggcttcctgtggctttgttttcttagttactttttccgtgccgtgtattttttaattgatttttcttcttttacttgaaaagaaagtgttttattttcaaatctggtccatatttacattctagttcagagccaagccttaaactgtacagaatttccactgtaattaaaactatttagtgttagttataaatagccttcaaaaagagagattctccattacacgatcacctgcatcacagcccatggtgaatgtatgtttctgcatagcgaaataaaaatggcaaatgcactg

SEQ ID NO: 9800 - DNA, 1656 bp, Homo sapiens
gaaggctgaggaggagcgggacgaggaagaggacaaacggaggaagggggaagaagtcacgcccatctcggccatccggcacgagggaaagactgacagtgagcgcacggacaccgcagccgacggggagaccactgccactgaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagccaagtgtgataaagaaaatgcaggaaggagactctgctgactctgtggttacttctcgtcaaataattttccagaaaactgtcccatcaaccctagagactaagcagtcttctggggaaaagctcatggatggctctgaaatcttcagtttattagagtctgcgcgaaaaccaacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataacc

SEQ ID NO: 9801 - DNA, 2083 bp, Homo sapiens
aggtggcaacttggaggtgccgccaccgcagctgcgggaggagcccgggtctggcggccccttccagcctccaggagctctttcccgccgccgagcccgagactggaccccggagaattcgaaggaaagagcccctgcggagggacctgtgagcagccctacctctctctgcccttgcgctactttttttctccaaggaaggttgtgcctgcgggctgcgaacaagctccgggaggggccccaaaggaaggcttcggtgactcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaagaattggttggaccctgctaaggaaataaaaaaacaggttcgaagtggtgcttggcacttttcatttaatgtgaaattttatccaccagaccctgcccaactatctgaagatatcaccaggtactacctctgcttgcagttgcgagatgacatcgtgtccggaaggctgccctgctcctttgttaccctggccttgctgggctcctacactgtccagtcagagctcggagactatgacccagatgaatgtgggagcgattacattagtgagttccgctttgcaccaaaccacactaaagaactggaagacaaagtgatcgagctgcacaagagccacagaggaatgacgccagcagaagcagagatgcatttcttggaaaatgccaaaaaattatcaatgtatggggtagatttacatcatgctaaggactcagaaggggtagaaattatgttaggagtttgtgcaagtggtctgttgatatatcgcgaccggctgcgaataaacagatttgcctggcccaaggttctaaagatttcatacaaacggaacaacttttacattaagatccggccgggagagtttgaacaatttgaaagcaccattgggtttaagctgccaaaccatcgagctgccaagcgtttatggaaagtatgtgttgagcatcatacatttttcagactactgttaccagaagcacctcccaagaaattcctaaccttgggttccaagtttcgttatagtggcaggacacaagcgcaaacgagaagagccagtgcgttgatagatcgcccagcaccttactttgaacgctcatccagcaaacgttataccatgtctcgcagcttggatggagcatcagtgaatgaaaaccatgaaatatacatgaaggattctatgtctgctgcagaggttggtactggccagtacgccacaacaaaaggcatctctcagaccaacttgatcaccactgtgactccggagaagaaggctgaggaggagcgggacgaggaagaggacaaacggaggaagggggaagaagtcacgcccatctcggccatccggcacgagggaaagactgacagtgagcgcacggacaccgcagccgacggggagaccactgccactgaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagaaaatggaaaccaagacggagtccagtggaatag

SEQ ID NO: 9802 - DNA, 3284 bp, Homo sapiens
gttatttgatttgccttggctgtggggaattctgtgctcagaagcaaggactggagcagtgaagtcattgtcctgcctggtgttgtgacatcactatggctcaaaggaaacaagggtggggcaggcaaaaccagaccatctgaagcatcttgctggctttaaaactttgcctgatcaatcaatgagactcctttctcaagttgaactgcattgcgagaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaagaattggttggaccctgctaaggaaataaaaaaacaggttcgaagtggtgcttggcacttttcatttaatgtgaaattttatccaccagaccctgcccaactatctgaagatatcaccaggtactacctctgcttgcagttgcgagatgacatcgtgtccggaaggctgccctgctcctttgttaccctggccttgctgggctcctacactgtccagtcagagctcggagactatgacccagatgaatgtgggagcgattacattagtgagttccgctttgcaccaaaccacactaaagaactggaagacaaagtgatcgagctgcacaagagccacagaggaatgacgccagcagaagcagagatgcatttcttggaaaatgccaaaaaattatcaatgtatggggtagatttacatcatgctaaggactcagaaggggtagaaattatgttaggagtttgtgcaagtggtctgttgatatatcgcgaccggctgcgaataaacagatttgcctggcccaaggttctaaagatttcatacaaacggaacaacttttacattaagatccggccgggagagtttgaacaatttgaaagcaccattgggtttaagctgccaaaccatcgagctgccaagcgtttatggaaagtatgtgttgagcatcatacatttttcagactactgttaccagaagcacctcccaagaaattcctaaccttgggttccaagtttcgttatagtggcaggacacaagcgcaaacgagaagagccagtgcgttgatagatcgcccagcaccttactttgaacgctcatccagcaaacgttataccatgtctcgcagcttggatggagcatcagtgaatgaaaaccatgaaatatacatgaaggattctatgtctgctgcagaggttggtactggccagtacgccacaacaaaaggcatctctcagaccaacttgatcaccactgtgactccggagaagaaggctgaggaggagcgggacgaggaagaggacaaacggaggaagggggaagaagtcacgcccatctcggccatccggcacgagggaaagactgacagtgagcgcacggacaccgcagccgacggggagaccactgccactgagtcggaccaggaggaagatgcagagctcaaggcacaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagactaagcagtcttctggggaaaagctcatggatggctctgaaatcttcagtttattagagtctgcgcgaaaaccaacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccaaaactgtgaaagggggcatttcagagacaagaattgagaagcgaatagtcatcacgggggatgcagacattgaccatgaccaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttac

SEQ ID NO: 9803 - DNA, 3190 bp, Homo sapiens
ctttggcgcgtcctgctcagaagccggggagctcctggccggcggctggcggggaagcgcggcgcgggaggaggtattgggagacaaaagaagctcatctataaacattttccatgaatcaagcagaaacttgggttttaaaggattcgcatagaacgggatgccacaggcaaggacagatcccctgaggctgtggaatgagtggggacatccccgcccatctctggtcttgactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaagaattggttggaccctgctaaggaaataaaaaaacaggttcgaagtggtgcttggcacttttcatttaatgtgaaattttatccaccagaccctgcccaactatctgaagatatcaccaggtactacctctgcttgcagttgcgagatgacatcgtgtccggaaggctgccctgctcctttgttaccctggccttgctgggctcctacactgtccagtcagagctcggagactatgacccagatgaatgtgggagcgattacattagtgagttccgctttgcaccaaaccacactaaagaactggaagacaaagtgatcgagctgcacaagagccacagaggaatgacgccagcagaagcagagatgcatttcttggaaaatgccaaaaaattatcaatgtatggggtagatttacatcatgctaaggactcagaaggggtagaaattatgttaggagtttgtgcaagtggtctgttgatatatcgcgaccggctgcgaataaacagatttgcctggcccaaggttctaaagatttcatacaaacggaacaacttttacattaagatccggccgggagagtttgaacaatttgaaagcaccattgggtttaagctgccaaaccatcgagctgccaagcgtttatggaaagtatgtgttgagcatcatacatttttcagactactgttaccagaagcacctcccaagaaattcctaaccttgggttccaagtttcgttatagtggcaggacacaagcgcaaacgagaagagccagtgcgttgatagatcgcccagcaccttactttgaacgctcatccagcaaacgttataccatgtctcgcagcttggatggagcatcagtgaatgaaaaccatgaaatatacatgaaggattctatgtctgctgcagaggttggtactggccagtacgccacaacaaaaggcatctctcagaccaacttgatcaccactgtgactccggagaagaaggctgaggaggagcgggacgaggaagaggacaaacggaggaagggggaagaagtcacgcccatctcggccatccggcacgagggaaagactgacagtgagcgcacggacaccgcagccgacggggagaccactgccactgaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaac

SEQ ID NO: 9804 - DNA, 4553 bp, Homo sapiens
tggatatgggactcctgtttgtggcctcctctcttccagagtcttccagtgcagtccagataacatctctgagagtctcttgagaccactgaagcaagaggcttcaaggtttgttctaggcttctctagttggcaggtcttccccatcccaccccctcccccagggctgccaggcgtattcctgcctgggcctcctggcacaagagataaaatgaacagggttactcccagtaactggtccaggagataccagcagagagggagtaggagagaagaaacatgtcagggtgctcacaggagtagtggggggaggttttgctatttccagattcttaagccaacaaaagtgccttcatattttctgtctggaagacagaaagcccagaaggagcccagaagcaacagtttgagagaggcgctttctgcggccaagtggataagaggagcggcctgcaaccatgggacagggtgagccaagccagcgctcgacagggcttgctggactgtatgcagcccccgcagcatcacctgttttcattaaaggaagtgggatggatgccctgggtatcaagagctgtgactttcaggcagcaagaaacaatgaggagcaccacaccaaggccctcagctcccggcgcctctttgtgaggagggggcagcccttcaccatcatcctgtacttccgcgctccagtccgtgcatttctgcctgccctgaagaaggtggccctcactgcacaaactggagagcagccttccaagatcaacaggacccaagccacattcccaatttccagtctgggggaccgaaagtggtggagtgcagtggtggaggagagagatgcccagtcctggaccatctctgtgaccacacctgcggacgctgtcattggccactactcgcttctgctgcaggtctcaggcaggaagcaactcctcttgggtcagttcacactgctttttaacccctggaatagagaggatgctgtgttcctgaagaatgaggctcagcgcatggagtacttgttgaaccagaatggtctcatctacctgggtacagctgactgcatccaggcagagtcctgggactttggccagttcgagggggatgtcattgacctcagcctgcgcttgctgagcaaggacaagcaggtagagaagtggagccagccggtgcacgtggcccgtgtgttgggtgccttgctgcattttctcaaggagcagagggtcctgcccaccccgcagacccaggccacccaggaaggggccttgctgaacaagcgccggggcagcgtgcccatcctgcggcagtggctcaccggccgaggccgacctgtgtatgatggccaggcctgggtgttggctgctgttgcttgcacagtgctgcgatgcctgggaatccctgcccgcgtggtgaccacgtttgcctcagcacagggcaccggtgggcgtcttctcatagatgaatactataatgaggagggacttcagaacggagaaggccagagaggcagaatctggatcttccagacttccacagagtgctggatgacgcggcctgccttgccccagggttatgatggatggcagattctgcacccaagtgctcctaatggaggtggagtcctggggtcctgtgatctggtgccggtcagagcagtcaaggaggggacgctggggctgaccccagcagtgtcagacctttttgctgccataaatgcctcatgtgtggtctggaagtgctgtgaggatgggacactggagttgactgactccaacacaaagtatgttggcaacaacatcagcaccaagggtgtgggcagtgaccgctgcgaggacatcactcagaactacaagtatcctgaagggtctcttcaggaaaaagaggtgctggagagagtcgagaaagagaaaatggaacgtgagaaagacaacggcatccgtcctcccagtctcgagactgccagtcctctgtacctgctcttgaaagcacccagctccctacccctgagaggggatgcccagatctcagtgacgctggttaatcacagtgagcaggagaaggcagtgcagctggcaattggggtccaggctgtacactacaacggtgtccttgctgccaagctctggaggaagaagctgcacctcacgctcagtgccaacctggaaaagataataaccatcggcctgttcttctccaattttgagcgaaacccacccgagaacaccttccttagactcaccgccatggcaacacactctgaatccaaccttagctgctttgctcaggaagacattgccatttgtagaccacaccttgccatcaagatgccagagaaagcagagcagtatcaacccctcacagcctcagtcagcctccagaactccctagatgcccccatggaggactgtgtgatctccatcctgggaagggggctcattcacagagagaggagctacagattccgttcagtgtggcctgaaaacaccatgtgtgccaagttccagttcacgccaacacatgtggggctccagagactcactgtggaagtggactgcaacatgttccagaacctaaccaactataaaagcgtcaccgtggtagcccctgaactatcagcttaaacttccagctctatcaccactctcctgccaacccttgttctacaatctaaaccaaacatgtgctaggaagagaaactttgcgtctcagtgtttgtgttgctataaaggaataactgaggctgggtagtttaaaagaaaagagctttatttggctcacggctctgcaggctgtacaagaaacagtgagggcttcaggctgcttccacttatgcaggaagatgaagggaggcaacgtgagcagagatcacagggcaagaatgggttgaggggtaggggtaagtgccaggtgccagcctcgttttaacagccagctctggggtgggggagggacatatagagcgagaacttactcattaccccaccaatggaacgaagccattcatgagggatccaaacacctcccattaggccccacctccaacactgggaatccaatttcagcatgaggtttgcagggttgaatatccaaactacatcactttatcagataaatgagtagtcattcaggttgaaaaggtgctcagatacctttaaggagtacattcagattgttcaggttcaggttttttgcaaccattttactgctcattaatacattcattaacttacagataagggaaaggacctaacacttaaatcattctaatatttctgatgaagtgggatattatcccaaaatggaatttttaggtaatcttaaaattacattgatcaagctgggctcggtggctcacatctgtaatcccagcactttgggaggctgacgtgggcagatcacctgaggtcaggagtttgagaccagcctggccaacatggtgaaaccccatctctactaaaaatacaaaaattagctggacatggtggtgtgcatctgtagtcccagctacttgagaggctgaagccagagaattgcttgagaacctgggaggcggaggttgcagtgagccgagagtgtgccactgcactccagcttgggggacagagcaagactccatctcaaaaaaaaaaaaaaaaaaaaaaaaattacattgatcagtgctttccctgatcattatccttaaagatccaaacatgactgaacgaagttatacaatacaggacctgagagaataattcagctagaggtaagtctttatattagagttctatattcattaagtatcccacaattaaagtctgatgttaataacatgaatttggtccagtagagaaatataaaagtatataaaaaataggctctatatgaaaggataaaagaactagactgttgtacaatgttattattttgtttatgttattttgttgccttgacactctgtcagtttgattttagttccttcccttcatgacacttgttaacaatacaaaatggcacttcaaaacagtaagctaaaactcatttggcttaaggaatttcaaccccaaccccaagtatacattagtcactcaaagaatgactgctgttgctgattatacctaaagacagcagaaaggcatatgttatgaattacacctacaaaaggaagatgatgggcatgagaggtggcggagacctgtaggacatgcataatgccctattcagctcaccagaatatacatcattatagatttacactgctttccaatatgcagtcttctagactgatgcaaaagtataattaagtggtgatggttttgcaaaaggatgaactgaaaaggcccttaaaattacataaaatctcttacacactaaaaaatttttgatttataaaaatttggtatttacatttggggacacacgtaaccaaggacaacacaagtatgtataaggaaaataaatctgttcaataaggtgggcaaacctaacaaatgagctcaatgccaatatattttagagacatggagtaatctgtgataatattcagaaggacttgctgataataatatata

SEQ ID NO: 9805 - DNA, 1976 bp, Homo sapiens
gcccagaaggagcccagaagcaacagtttgagagaggcgctttctgcggccaagtggataagaggagcggcctgcaaccatgggacaggccctgggtatcaagagctgtgactttcaggcagcaagaaacaatgaggagcaccacaccaaggccctcagctcccggcgcctctttgtgaggagggggcagcccttcaccatcatcctgtacttccgcgctccagtccgtgcatttctgcctgccctgaagaaggtggccctcactgcacaaactggagagcagccttccaagatcaacaggacccaagccacattcccaatttccagtctgggggaccgaaagtggtggagtgcagtggtggaggagagagatgcccagtcctggaccatctctgtgaccacacctgcggacgctgtcattggccactactcgcttctgctgcaggtctcaggcaggaagcaactcctcttgggtcagttcacactgctttttaacccctggaatagagaggatgctgtgttcctgaagaatgaggctcagcgcatggagtacttgttgaaccagaatggtctcatctacctgggtacagctgactgcatccaggcagagtcctgggactttggccagttcgagggggatgtcattgacctcagcctgcgcttgctgagcaaggacaagcaggtagagaagtggagccagccggtgcacgtggcccgtgtgttgggtgccttgctgcattttctcaaggagcagagggtcctgcccaccccgcagacccaggccacccaggaaggggccttgctgaacaagcgccggggcagcgtgcccatcctgcggcagtggctcaccggccgaggccgacctgtgtatgatggccaggcctgggtgttggctgctgttgcttgcacagtgctgcgatgcctgggaatccctgcccgcgtggtgaccacgtttgcctcagcacagggcaccggtgggcgtcttctcatagatgaatactataatgaggagggacttcagaacggagaaggccagagaggcagaatctggaagtgctgtgaggatgggacactggagttgactgactccaacacaaagtatgttggcaacaacatcagcaccaagggtgtgggcagtgaccgctgcgaggacatcactcagaactacaagtatcctgaagggtctcttcaggaaaaagaggtgctggagagagtcgagaaagagaaaatggaacgtgagaaagacaacggcatccgtcctcccagtctcgagactgccagtcctctgtacctgctcttgaaagcacccagctccctacccctgagaggggatgcccagatctcagtgacgctggttaatcacagtgagcaggagaaggcagtgcagctggcaattggggtccaggctgtacactacaacggtgtccttgctgccaagctctggaggaagaagctgcacctcacgctcagtgccaacctggaaaagataataaccatcggcctgttcttctccaattttgagcgaaacccacccgagaacaccttccttagactcaccgccatggcaacacactctgaatccaaccttagctgctttgctcaggaagacattgccatttgtagaccacaccttgccatcaagatgccagagaaagcagagcagtatcaacccctcacagcctcagtcagcctccagaactccctagatgcccccatggaggactgtgtgatctccatcctgggaagggggctcattcacagagagaggagctacagattccgttcagtgtggcctgaaaacaccatgtgtgccaagttccagttcacgccaacacatgtggggctccagagactcactgtggaagtggactgcaacatgttccagaacctaaccaactataaaagcgtcaccgtggtagcccctgaactatcagcttaaacttccagctctatcaccactctcctgccaacccttg

SEQ ID NO: 9806 - DNA, 2446 bp, Homo sapiens
ccccagggctgccaggcgtattcctgcctgggcctcctggcacaagagataaaatgaacagggttactcccagtaactggtccaggagataccagcagagagggagtaggagagaagaaacatgtcagggtgctcacaggagtagtggggggaggttttgctatttccagattcttaagccaacaaaagtgccttcatattttctgtctggaagacagaaagcccagaaggagcccagaagcaacagtttgagagaggcgctttctgcggccaagtggataagaggagcggcctgcaaccatgggacaggccctgggtatcaagagctgtgactttcaggcagcaagaaacaatgaggagcaccacaccaaggccctcagctcccggcgcctctttgtgaggagggggcagcccttcaccatcatcctgtacttccgcgctccagtccgtgcatttctgcctgccctgaagaaggtggccctcactgcacaaactggagagcagccttccaagatcaacaggacccaagccacattcccaatttccagtctgggggaccgaaagtggtggagtgcagtggtggaggagagagatgcccagtcctggaccatctctgtgaccacacctgcggacgctgtcattggccactactcgcttctgctgcaggtctcaggcaggaagcaactcctcttgggtcagttcacactgctttttaacccctggaatagagaggatgctgtgttcctgaagaatgaggctcagcgcatggagtacttgttgaaccagaatggtctcatctacctgggtacagctgactgcatccaggcagagtcctgggactttggccagttcgagggggatgtcattgacctcagcctgcgcttgctgagcaaggacaagcaggtagagaagtggagccagccggtgcacgtggcccgtgtgttgggtgccttgctgcattttctcaaggagcagagggtcctgcccaccccgcagacccaggccacccaggaaggggccttgctgaacaagcgccggggcagcgtgcccatcctgcggcagtggctcaccggccgaggccgacctgtgtatgatggccaggcctgggtgttggctgctgttgcttgcacagtgctgcgatgcctgggaatccctgcccgcgtggtgaccacgtttgcctcagcacagggcaccggtgggcgtcttctcatagatgaatactataatgaggagggacttcagaacggagaaggccagagaggcagaatctggatcttccagacttccacagagtgctggatgacgcggcctgccttgccccagggttatgatggatggcagattctgcacccaagtgctcctaatggaggtggagtcctggggtcctgtgatctggtgccggtcagagcagtcaaggaggggacgctggggctgaccccagcagtgtcagacctttttgctgccataaatgcctcatgtgtggtctggaagtgctgtgaggatgggacactggagttgactgactccaacacaaagtatgttggcaacaacatcagcaccaagggtgtgggcagtgaccgctgcgaggacatcactcagaactacaagtatcctgaagggtctcttcaggaaaaagaggtgctggagagagtcgagaaagagaaaatggaacgtgagaaagacaacggcatccgtcctcccagtctcgagactgccagtcctctgtacctgctcttgaaagcacccagctccctacccctgagaggggatgcccagatctcagtgacgctggttaatcacagtgagcaggagaaggcagtgcagctggcaattggggtccaggctgtacactacaacggtgtccttgctgccaagctctggaggaagaagctgcacctcacgctcagtgccaacctggaaaagataataaccatcggcctgttcttctccaattttgagcgaaacccacccgagaacaccttccttagactcaccgccatggcaacacactctgaatccaaccttagctgctttgctcaggaagacattgccatttgtagaccacaccttgccatcaagatgccagagaaagcagagcagtatcaacccctcacagcctcagtcagcctccagaactccctagatgcccccatggaggactgtgtgatctccatcctgggaagggggctcattcacagagagaggagctacagattccgttcagtgtggcctgaaaacaccatgtgtgccaagttccagttcacgccaacacatgtggggctccagagactcactgtggaagtggactgcaacatgttccagaacctaaccaactataaaagcgtcaccgtggtagcccctgaactatcagcttaaacttccagctctatcaccactctcctgccaacccttgttctacaatctaaaccaaacatgtgctaggaag

SEQ ID NO: 9807 - DNA, 2098 bp, Homo sapiens
gaaacatgtcagggtgctcacaggagtagtggggggaggttttgctatttccagattcttaagccaacaaaagtgccttcatattttctgtctggaagacagaaagcccagaaggagcccagaagcaacagtttgagagaggcgctttctgcggccaagtggataagaggagcggcctgcaaccatgggacaggccctgggtatcaagagctgtgactttcaggcagcaagaaacaatgaggagcaccacaccaaggccctcagctcccggcgcctctttgtgaggagggggcagcccttcaccatcatcctgtacttccgcgctccagtccgtgcatttctgcctgccctgaagaaggtggccctcactgcacaaactgaggatgctgtgttcctgaagaatgaggctcagcgcatggagtacttgttgaaccagaatggtctcatctacctgggtacagctgactgcatccaggcagagtcctgggactttggccagttcgagggggatgtcattgacctcagcctgcgcttgctgagcaaggacaagcaggtagagaagtggagccagccggtgcacgtggcccgtgtgttgggtgccttgctgcattttctcaaggagcagagggtcctgcccaccccgcagacccaggccacccaggaaggggccttgctgaacaagcgccggggcagcgtgcccatcctgcggcagtggctcaccggccgaggccgacctgtgtatgatggccaggcctgggtgttggctgctgttgcttgcacagtgctgcgatgcctgggaatccctgcccgcgtggtgaccacgtttgcctcagcacagggcaccggtgggcgtcttctcatagatgaatactataatgaggagggacttcagaacggagaaggccagagaggcagaatctggatcttccagacttccacagagtgctggatgacgcggcctgccttgccccagggttatgatggatggcagattctgcacccaagtgctcctaatggaggtggagtcctggggtcctgtgatctggtgccggtcagagcagtcaaggaggggacgctggggctgaccccagcagtgtcagacctttttgctgccataaatgcctcatgtgtggtctggaagtgctgtgaggatgggacactggagttgactgactccaacacaaagtatgttggcaacaacatcagcaccaagggtgtgggcagtgaccgctgcgaggacatcactcagaactacaagtatcctgaagggtctcttcaggaaaaagaggtgctggagagagtcgagaaagagaaaatggaacgtgagaaagacaacggcatccgtcctcccagtctcgagactgccagtcctctgtacctgctcttgaaagcacccagctccctacccctgagaggggatgcccagatctcagtgacgctggttaatcacagtgagcaggagaaggcagtgcagctggcaattggggtccaggctgtacactacaacggtgtccttgctgccaagctctggaggaagaagctgcacctcacgctcagtgccaacctggaaaagataataaccatcggcctgttcttctccaattttgagcgaaacccacccgagaacaccttccttagactcaccgccatggcaacacactctgaatccaaccttagctgctttgctcaggaagacattgccatttgtagaccacaccttgccatcaagatgccagagaaagcagagcagtatcaacccctcacagcctcagtcagcctccagaactccctagatgcccccatggaggactgtgtgatctccatcctgggaagggggctcattcacagagagaggagctacagattccgttcagtgtggcctgaaaacaccatgtgtgccaagttccagttcacgccaacacatgtggggctccagagactcactgtggaagtggactgcaacatgttccagaacctaaccaactataaaagcgtcaccgtggtagcccctgaactatcagcttaaacttccagctctatcaccactctcctgccaacccttgttctacaatctaaaccaaacatgtgctaggaagag

SEQ ID NO: 9808 - DNA, 2554 bp, Homo sapiens
gttgcctggttgtgagagtcaggggagcagggacaggtccaagacaaggaaggcagttgggctgtgggaatggggagcccagggaaggcctccagagctggcctggagagtcaccgccgagggatgaggacgcgccagcccgggggaacgcgccagctgctttcgcggccccaagcgcgcagcgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcctcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccctaca

SEQ ID NO: 9809 - DNA, 2772 bp, Homo sapiens
gagaaaagatgaagaaagccaagaaaagggaccagaagagaaagcagaaagacaggaggaagaaagggagagagggccaggcagtcgcactgtgaacagaacaggagaaggcgaagcggggcaaagttccctgcccaccgacgccagcctgcttggatgacttgcctcgtttcataattcacttactgtctgcaccagccggcctccagcctggctggaccctgctgcctgtgtggcccggagccagaggcccccacactcccagctgctcttctacagatgccatcaacgagcaggactctgggtggctccactgtctaagcctggagagtcaccgccgagggatgaggacgcgccagcccgggggaacgcgccagctgctttcgcggccccaagcgcgcagcgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggtctccagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcctcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccct

SEQ ID NO: 9810 - DNA, 2081 bp, Homo sapiens
gttgcctggttgtgagagtcaggggagcagggacaggtccaagacaaggaaggcagttgggctgtgggaatggggagcccagggaaggcctccagagctggcctggagagtcaccgccgagggatgaggacgcgccagcccgggggaacgcgccagctgctttcgcggccccaagcgcgcagcgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttcggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcctcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttga

SEQ ID NO: 9811 - DNA, 2601 bp, Homo sapiens
agagaagcctatcgacagggcctgggggagggaggaggcagcagggccggagtccacccaggacatctggcaccagtgaccttgtggggaaaggagccaagaacggggcgtcggggggcctgggacccccctgcctgagagatacaggaatcctggccccgtgttgtggacacaagcgcccatcctcaaggtcctgagaactcctgaacttccaaagcctggagagtcaccgccgagggatgaggacgcgccagcccgggggaacgcgccagctgctttcgcggccccaagcgcgcagcgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcctcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccct

SEQ ID NO: 9812 - DNA, 2573 bp, Homo sapiens
gagaaaagatgaagaaagccaagaaaagggaccagaagagaaagcagaaagacaggaggaagaaagggagagagggccaggcagtcgcactgtgaacagaacaggagaaggcgaagcggggcaaagttccctgcccaccgacgccagcctgcttggatgacttgcctcgtttcataattcacttactgtctgcaccagccggcctccagcctggctggaccctgctgcctgtgtggcccggagccagaggcccccacactcccagctgctcttctacagatgccatcaacgagcaggactctgggtggctccactgtctaagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcctcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccct

SEQ ID NO: 9813 - DNA, 2508 bp, Homo sapiens
tctctgaggaagaggcagcgggaggcacagcttcctcctccccccctccctgctgccgcggctgagccgggcctgagctgccggcaggttgtcttggcaacaggaggtggagaggagatgcgccgagggatggaggtgtatgtcaccgaggaggctgctgcgctcctgccccacgccctgggcccttgaagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggtctccagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcctcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccct

SEQ ID NO: 9814 - DNA, 2415 bp, Homo sapiens
aggttgtcttggcaacaggaggtggagaggagatgcgccgagggatggaggtgtatgtcaccgaggaggctgctgcgctcctgccccacgccctgggcccttgaagcctggagagtcaccgccgagggatgaggacgcgccagcccgggggaacgcgccagctgctttcgcggccccaagcgcgcagcgcccagcagccgcgccgagcctgacacgctgtcctctcccctcgcgcacagggctctgcgagtgacccggcgggcgagctccgtgctgcatggaacggctgcagaaggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcctcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccct

SEQ ID NO: 9815 - DNA, 2658 bp, Homo sapiens
aagacaggaggaagaaagggagagagggccaggcagtcgcactgtgaacagaacaggagaaggcgaagcggggcaaagttccctgcccaccgacgccagcctgcttggatgacttgcctcgtttcataattcacttactgtctgcaccagccggcctccagcctggctggaccctgctgcctgtgtggcccggagccagaggcccccacactcccagctgctcttctacagatgccatcaacgagcaggactctgggtggctccactgtctaagcctggagagtcaccgccgagggatgaggacgcgccagcccgggggaacgcgccagctgctttcgcggccccaagcgcgcagcgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcctcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccct

SEQ ID NO: 9816 - DNA, 2735 bp, Homo sapiens
ccagaagagaaagcagaaagacaggaggaagaaagggagagagggccaggcagtcgcactgtgaacagaacaggagaaggcgaagcggggcaaagttccctgcccaccgacgccagcctgcttggatgacttgcctcgtttcataattcacttactgtctgcaccagccggcctccagcctggctggaccctgctgcctgtgtggcccggagccagaggcccccacactcccagctgctcttctacagatgccatcaacgagcaggactctgggtggctccactgtctaagcctggagagtcaccgccgagggatgaggacgcgccagcccgggggaacgcgccagctgctttcgcggccccaagcgcgcagcgcccagcagccgcgccgagcctgacacgctgtcctctcccctcgcgcacagggctctgcgagtgacccggcgggcgagctccgtgctgcatggaacggctgcagaagcaaccacttacctcccccgggagcgtgagcccctcccgagattccagtgtgcctggctctccctccagcatcgtggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgagcgctcgctgtcacccaaatccacatcccccccaccatccccagaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggcctgcagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcacagggcaaagccagtctgggctctggcacacagagttcatgtttgcgccctctccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcctcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgg

SEQ ID NO: 9817 - DNA, 1569 bp, Homo sapiens
gagatgcgccgagggatggaggtgtatgtcaccgaggaggctgctgcgctcctgccccacgccctgggcccttgaagcctggagagtcaccgccgagggatgaggacgcgccagcccgggggaacgcgccagctgctttcgcggccccaagcgcgcagcgcccagcagccgcgccgagcctgacacgctgtcctctcccctcgcgcacagggctctgcgagtgacccggcgggcgagctccgtgctgcatggaacggctgcagaaggccaagatggacaatcaggtgctgggctacaaggacctggctgccatccccaaggacaaggccatcctggacatcgagcggcccgacctcatgatctacgagcctcacttcacttattccctcctggaacacgtggagctgcctcgcagccgcgaggtgtgggcggacagccggtcgcctggaatcatctctcaggcctcggcccccagaaccactggaaccccccggaccagcctgccccatttccaccaccctgagacctcccgcccagattccaacatctacaagaagcctcccatctataagcagagagagtccgtgggaggcagccctcagaccaagcacctcatcgaggatctcatcatcgagtcatccaagtttcctgcagcccagcccccagaccccaaccagccagccaaaatcgaaaccgactactggccatgccccccgtctctggctgttgtggagacagaatggaggaagcggaaggcgtctcggaggggagcagaggaagaggaggaggaggaagatgacgactctggagaggagatgaaggctctcagggagcgtcagagagaggaactcagtaaggttacttccaacttgggaaagatgatcttgaaagaagagatggaaaagtcattgccgatccgaaggaaaacccgctctctgcctgaccggacacccttccatacctccttgcaccagggaacgtctaaatcttcctctctccccgcctatggcaggaccaccctgagccggctacagtccacagagttcagcccatcagggagtgagactggaagcccaggtctccagaacggagagggccagagggggaggatggaccgggggaactccctgccctgtgtgctggagcagaagatctatccctatgaaatgctagtggtgaccaacaaggggcgaaccaagctgccaccgggggtggatcggatgcggcttgagaggcatctgtctgccgaggacttctcaagggtatttgccatgtcccctgaagagtttggcaagctggctctgtggaagcggaatgagctcaagaagaaggcctctctcttctgatggcccccacctgctccgggacggcccccttacccctgctgcttcagggtttttccccggcgggttgggaggggcaggaggtggggtggaaatagggtgggctcctttcctcaggtagagtggggggccaaaacctctgcagtccccggcagtgagctatggactttcttccccctcacaaggctgggggcctcctgctctcgtccctggccctccctgcaca

SEQ ID NO: 9818 - DNA, 2441 bp, Homo sapiens
cttagaggcgcctggtcgggaagggcctggtcagctgcgtccggcggaggcagctgctgacccagctgtggactgtgccgggggcgggggacggaggggcaggagccctgggctccccgtggcgggggctgtatcatggaccacctcggggcgtccctctggccccaggtcggctccctttgtctcctgctcgctggggccgcctgggcgcccccgcctaacctcccggaccccaagttcgagagcaaagcggccttgctggcggcccgggggcccgaagagcttctgtgcttcaccgagcggttggaggacttggtgtgtttctgggaggaagcggcgagcgctggggtgggcccgggcaactacagcttctcctaccagctcgaggatgagccatggaagctgtgtcgcctgcaccaggctcccacggctcgtggtgcggtgcgcttctggtgttcgctgcctacagccgacacgtcgagcttcgtgcccctagagttgcgcgtcacagcagcctccggcgctccgcgatatcaccgtgtcatccacatcaatgaagtagtgctcctagacgcccccgtggggctggtggcgcggttggctgacgagagcggccacgtagtgttgcgctggctcccgccgcctgagacacccatgacgtctcacatccgctacgaggtggacgtctcggccggcaacggcgcagggagcgtacagagggtggagatcctggagggccgcaccgagtgtgtgctgagcaacctgcggggccggacgcgctacaccttcgccgtccgcgcgcgtatggctgagccgagcttcggcggcttctggagcgcctggtcggagcctgtgtcgctgctgacgcctagcgacctggaccccctcatcctgacgctctccctcatcctcgtggtcatcctggtgctgctgaccgtgctcgcgctgctctcccaccgccgggctctgaagcagaagatctggcctggcatcccgagcccagagagcgagtttgaaggcctcttcaccacccacaagggtaacttccagctgtggctgtaccagaatgatggctgcctgtggtggagcccctgcacccccttcacggaggacccacctgcttccctggaagtcctctcagagcgctgctgggggacgatgcaggcagtggagccggggacagatgatgagggccccctgctggagccagtgggcagtgagcatgcccaggatacctatctggtgctggacaaatggttgctgccccggaacccgcccagtgaggacctcccagggcctggtggcagtgtggacatagtggccatggatgaaggctcagaagcatcctcctgctcatctgctttggcctcgaagcccagcccagagggagcctctgctgccagctttgagtacactatcctggaccccagctcccagctcttgcgtccatggacactgtgccctgagctgccccctaccccaccccacctaaagtacctgtaccttgtggtatctgactctggcatctcaactgactacagctcaggggactcccagggagcccaagggggcttatccgatggcccctactccaacccttatgagaacagccttatcccagccgctgagcctctgccccccagctatgtggcttgctcttaggacaccaggctgcagatgatcagggatccaatatgactcagagaaccagtgcagactcaagacttatggaacagggatggcgaggcctctctcaggagcaggggcattgctgattttgtctgcccaatccatcctgctcaggaaaccacaaccttgcagtatttttaaatatgtatagtttttttttgtatctatatatatatatacacatatgtatgtaagtttttctaccatgatttctacaaacaccctttaagtcccatcttcccctgggcataggccatagggatagaagttaaagttcttgagcttattcagaagctggatctgcaatctgaatgctactcataacataacaaaatagtatgttaaacagctcttaaatcttactggcttaccacattaaatgatttctctctcctaactcagctcaaatgggcagccatccatgggatgagtcagaggttcagactcttccagtctgtagctctaccttctcttagggtacttagatggatcccctgttctacaaactgccagtcagcaagggaagaaaaagggcagcaatgaccctcaatgggccatttgagggatctggcctggaaatgggcttcctctcttcttctcacacctcactggctggaaacagtcacatgaccccagtcacatgaaaggccaggaaacttagtttagctgtacacccaggaagggcaaagctgtttaagggccactagctagtctctgccactaataataataaaagtaattctgaatcaggc

SEQ ID NO: 9819 - DNA, 3531 bp, Homo sapiens
agcggagcgccaggcagcgcggagcggaggccaggcccacagccgctccgcctcccggcccgcagatccccgacggccgcaccgcgggctcctctggcccgcaagaacacgtgcatggcgtcctggggaaggcgctgagtgcggagtcgcggcgccgcacgcggcaccatggccctggagcaggcgctgcaggcggcgcggcagggcgagctggacgtgctgaggtcgctgcacgccgcaggcctcctggggccctcgctgcgcgacccgctggacgcgctgcccgtgcaccacgcggcccgcgctgggaagctgcactgtctgcgcttcctggtggaggaagccgccctccccgccgcggcccgcgcccgcaacggcgccacaccggcccacgacgcctccgccaccggccacctcgcctgcctgcagtggctgctgtcgcagggcggctgcagagtgcaggacaaagacaattctggtgccacagtcttgcatctggctgcccgcttcggccaccccgaggtggtgaactggctcttgcatcatggcggtggggaccccaccgcggccacagacatgggcgccctgcctatccactacgctgccgccaaaggagacttcccctccctgaggcttctcgtcgagcactaccctgagggagtgaatgcccaaaccaagaacggtgccacgcccctgtacctggcgtgccaggagggccacctggaggtgacccagtacctggtgcaggaatgcggcgcagacccgcacgcgcgcgcccacgacggcatgaccccgctgcacgccgcggcgcagatgggccacagcccagtcatcgtgtggttggtgagctgcaccgacgtgagcctgtccgagcaggacaaagacggcgccaccgccatgcacttcgcggcgagccgcggccacaccaaggtgctcagctggctgctgctgcacggcggggagatctcggctgacctgtggggcgggaccccgctgcacgacgccgccgagaacggggagctagagtgctgccagatcctggtagtgaacggcgcggagctggacgtccgcgaccgcgacgggtacacggccgccgacctgtcggacttcaacggccacagccactgcacccgctacctgcgcacggtggagaacctgagcgtggagcaccgcgtgctttcccgggatccatccgcagagctggaggctaagcagccggattcaggcatgtcctcacccaataccacggtgtcggtccagccgctgaactttgacctcagctcgcctaccagcaccctctccaactacgactcctgctcctccagccactccagcatcaagggccagcaccctccatgtgggctttccagcgctagagctgcagacatacagagctacatggacatgctgaacccggagctgggcctgcctcggggcacgattgggaagcccacacccccaccacccccacccagcttccccccgccacccccgcccccaggcacccaactgcccccacccccacctggctacccagctcccaagcctcctgtaggaccacaggcagctgacatctacatgcagaccaagaacaaactccgccacgtggagacagaggccctcaagaaggagctgagctcctgtgacggccacgacgggctgcggaggcaggactccagccgcaagccccgcgccttcagcaagcagcccagcacgggggactactaccggcagctgggccgctgccccggcgagacgctggccgcacgcccgggcatggcgcacagcgaggaggtgcgtgcccgccagcccgcgcgcgccggctgcccgcgcctcggccctgccgcccgcggctcactcgaaggcccctccgctcccccgcaggcggcgctgcttcctgggaaccatgttcctaacggctgcgccgcggaccccaaggcgtccagggagctgccaccgccgcccccaccgccgccgccgcccctgccggaggccgcgagttcgccaccgccggccccgcctctgcccctcgagagcgctggccctggctgcgggcagcgccgctcctcctcgtccaccggcagcaccaagtctttcaacatgatgtccccgacgggcgacaactcggagctactggctgagattaaggcaggcaagagcctgaagccgacgccccagagcaaggggctgaccacagtgttctcaggcatcgggcagccggccttccagcccgattcgccgctgccttctgtgtcacctgcactgtcaccagtccggagccccacaccgccagctgcggggtttcagccgctgctcaatggaagcttggttcccgtgccgcccactactcctgcgccgggagtgcagctggacgtggaggctctcatccccacgcacgatgagcagggccggcccatccccgagtggaagcgccaggtgatggtgcgcaagatgcagctgaagatgcaggaggaggaggagcagaggcggaaggaggaggaggaggaggcccggctggccagcatgcccgcctggaggcgggacctcctgcggaagaagctggaagaagagagggagcagaagcggaaagaggaggagcgacagaagcaggaggagctgcggcgggagaaggaacagtcagagaagctgcggacgctgggctacgatgagagcaagctggcgccctggcagcgacaggtcatcctgaagaagggggacatcgctaagtactagaggccgcagactcctgtccgcagcctcgcagctccgtggggccctccgccccagccccagccagccaggccctggtggaaaggctgggagccgcacagccctcccctcctgcgctggaaaccctccctgacccccaccctggccccccgtatccccagcccttggcaacactggagtgcacacgccgccacggttgcccagaaaaagtgcccaagctgctgacgcaaacaacaacaaatgctgcttatttgcatgccgacttacatatatttgcatgttcgttgactatcaaagagtgcagagctctccccagccccgtgggtggtgactttgttttcctgcggggctcagccccctccaggatgcagccccctcccccgcaccccggaaccggcgtcgctggcgcatcctgggtggaggcaggccccgagctcggggaaggggttttcccttcctctctgacccagatctgcgcgcggcctagcccgggcctcatttcttatccccgccaagggtttcctctcagtcatttgtttaccagaaacatgaaaactgcctgtctggccgggccgcacttgtggcccccgggaccccacctctggccccacctccctcaagtctgcgccccgtccccagccagacccactcgctgccgggaccctttcactgccccggtggagtgaatagaggatgaggggccctgaccctgtgtctccaactgctgcaccccatcccgaccctgtctccgccacctcgcagccccattaaagcgctctcatctgggctccggttcactca

SEQ ID NO: 9820 - DNA, 1665 bp, Homo sapiens
atggcgcacagcgaggaggcggcgctgcttcctgggaaccatgttcctaacggctgcgccgcggaccccaaggcgtccagggagctgccaccgccgcccccaccgccgccgccgcccctgccggaggccgcgagttcgccaccgccggccccgcctctgcccctcgagagcgctggccctggctgcgggcagcgccgctcctcctcgtccaccggcagcaccaagtctttcaacatgatgtccccgacgggcgacaactcggagctactggctgagattaaggcaggcaagagcctgaagccgacgccccagagcaaggggctgaccacagtgttctcaggcatcgggcagccggccttccagcccgattcgccgctgccttctgtgtcacctgcactgtcaccagtccggagccccacaccgccagctgcggggtttcagccgctgctcaatggaagcttggttcccgtgccgcccactactcctgcgccgggagtgcagctggacgtggaggctctcatccccacgcacgatgagcagggccggcccatccccgagtggaagcgccaggtgatggtgcgcaagatgcagctgaagatgcaggaggaggaggagcagaggcggaaggaggaggaggaggaggcccggctggccagcatgcccgcctggaggcgggacctcctgcggaagaagctggaagaagagagggagcagaagcggaaagaggaggagcgacagaagcaggaggagctgcggcgggagaaggaacagtcagagaagctgcggacgctgggctacgatgagagcaagctggcgccctggcagcgacaggtcatcctgaagaagggggacatcgctaagtactagaggccgcagactcctgtccgcagcctcgcagctccgtggggccctccgccccagccccagccagccaggccctggtggaaaggctgggagccgcacagccctcccctcctgcgctggaaaccctccctgacccccaccctggccccccgtatccccagcccttggcaacactggagtgcacacgccgccacggttgcccagaaaaagtgcccaagctgctgacgcaaacaacaacaaatgctgcttatttgcatgccgacttacatatatttgcatgttcgttgactatcaaagagtgcagagctctccccagccccgtgggtggtgactttgttttcctgcggggctcagccccctccaggatgcagccccctcccccgcaccccggaaccggcgtcgctggcgcatcctgggtggaggcaggccccgagctcggggaaggggttttcccttcctctctgacccagatctgcgcgcggcctagcccgggcctcatttcttatccccgccaagggtttcctctcagtcatttgtttaccagaaacatgaaaactgcctgtctggccgggccgcacttgtggcccccgggaccccacctctggccccacctccctcaagtctgcgccccgtccccagccagacccactcgctgccgggaccctttcactgccccggtggagtgaatagaggatgaggggccctgaccctgtgtctccaactgctgcaccccatcccgaccctgtctccgccacctcgcagccccattaaagcgctctcatctgggctccggttcactca

SEQ ID NO: 9821 - DNA, 641 bp, Homo sapiens
gacggcatgaccccgctgcacgccgcggcgcagatgggccacagcccagtcatcgtgtggttggacaaagacggcgccaccgccatgcacttcgcggcgagccgcggccacaccaaggtgctcagctggctgctgctgcacggcggggagatctcggctgacctgtggggcgggaccccgctgcacgacgccgccgagaacggggagctagagtgctgccagatcctggtagtgaacggcgcggagctggacgtccgcgaccgcgacgggtacacggccgccgacctgtcggacttcaacggccacagccactgcacccgctacctgcgcacggtggagaacctgagcgtggagcaccgcgtgctttcccgggatccatccgcagagctggaggctaagcagccggattcaggcatgtcctcacccaataccacggtgtcggtccagccgctgaactttgacctcagctcgcctaccagcaccctctccaactacgactcctgctcctccagccactccagcatcaagggccagcaccctccatgtgggctttccagcgctagagctgcagacatacagagctacatggacatgctgaacccggagctgggcctgcctcggggcacgattgggaagcccac

SEQ ID NO: 9822 - DNA, 750 bp, Homo sapiens
tgagattaaggcaggcaagagcctgaagccgacgccccagagcaaggggctgaccacagtgttctcaggcatcgggcagccggccttccagcccgattcgccgctgccttctgtgtcacctgcactgtcaccagtccggagccccacaccgccagctgcggggtttcagccgctgctcaatggaagcttggttcccgtgccgcccactactcctgcgccgggagtgcagctggacgtggaggctctcatccccacgcacgatgagcagggccggcccatccccgagtggaagcgccaggtgatggtgcgcaagatgcagctgaagatgcaggaggaggaggagcagaggcggaaggaggaggaggaggaggcccggctggccagcatgcccgcctggaggcgggacctcctgcggaagaagctggaagaagagagggagcagaagcggaaagaggaggagcgacagaagcaggaggagctgcggcgggagaaggaacagtcagagaagctgcggacgctgggctacgatgagagcaagctggcgccctggcagcgacagatttaataccgcgatctcagccaaactccggccgagaagttgagaaatgtcttcaccccctctcgacattcgttcgtgcttcttcgccttggctggagcgataggggcgagcaggggtggggccggctggtgctgctacgcagggccgtgccagcggcttaataagtgacataaaatgtctacacgcataa

SEQ ID NO: 9823 - DNA, 1335 bp, Homo sapiens
atggcgcgggttggacccgggagggcgggggtctcttgccagggccggggccggggacggggcgggagcggtcagcggcgacctccaacctgggagatctcagactccgacgctgaggactccgccggctcggaggccgccgcgagagcccgggacccagcgggtgagcgcagggcggctgccgaggcgttgcggctgctgcggccggagcaggtcctgaagcgcctcgcggtgtgcgtggacacagccatcctggaagacgccggtgccgacgtcctgatggaggccctggaggccctgggctgcgagtgccgcatcgagccccagcgcccggcccgcagcctgcggtggacccgagcgagtcccgacccctgcccccgcagcctgcctcctgaagtgtgggctgcaggtgaacaggaattgctgctgctgctggagcccgaggagtttctgcagggcgtcgccacactgacccagatctctggcccaacccactgggtgccctggatctcccccgagaccaccgcccggccccacctggctgtcatcgggctggatgcctacctgtggtaccgctcactctcatgcccacagcagggctggctgggacgggggttcaggggaggtgggctctggcagaggccaagctcgggcagggcaggccccatggggagcggggaggaatggtcacctctgctcaggtctcgccagcacgtttcccgggggacacagcagccagagagcccgaaggtggccggtgccgaggtggccgtcagctggccggaggtggaagaggtgagggcctgtctgagctgggccctggtactcctgcagctctgggcaaacctggacgtgctactggtggcctcttggcaggagctgagtcggcacgtgtgcgccgttaccaaggctctcgcccagtatcccctcaagtgcgtgatgccaaggctgaaggggggcaggatcacctcaaggcagtaccgggaatcccaggccttctccttctgcacagcagggcgctgggcagccggcgagccagtggcaagagacggcgcagggctgcaggcggcctggcggaggcagatcaggcagttcagtcgggtcagcccagccgtggctgatgcagttgtcacagccttcccctccccccgccttctgcagcaggcgctggaggcctgcagcacggagcgggagcgcatgggcctcctggccgaccttcctgtgccgcccagtgaaggcgggcgtccccgcagggtggggcctgacctctcccgccgcatctgcctcttcctgaccacagccaaccctgatctcctgctggacctgggctcctga

SEQ ID NO: 9824 - DNA, 1161 bp, Homo sapiens
atggcgcgggttggacccgggagggcgggggtctcttgccagggccggggccggggacggggcgggagcggtcagcggcgacctccaacctgggagatctcagactccgacgctgaggactccgccggctcggaggccgccgcgagagcccgggacccagcgggtgagcgcagggcggctgccgaggcgttgcggctgctgcggccggagcaggtcctgaagcgcctcgcggtgtgcgtggacacagccatcctggaagacgccggtgccgacgtcctgatggaggccctggaggccctgggctgcgagtgccgcatcgagccccagcgcccggcccgcagcctgcggtggacccgagcgagtcccgacccctgcccccgcagcctgcctcctgaagtgtgggctgcaggtgaacaggaattgctgctgctgctggagcccgaggagtttctgcagggcgtcgccacactgacccagatctctggcccaacccactgggtgccctggatctcccccgagaccaccgcccggccccacctggctgtcatcgggctggatgcctacctgtggtctcgccagcacgtttcccgggggacacagcagccagagagcccgaaggtggccggtgccgaggtggccgtcagctggccggaggtggaagaggtgagggcctgtctgagctgggccctggtactcctgcagctctgggcaaacctggacgtgctactggtggcctcttggcaggagctgagtcggcacgtgtgcgccgttaccaaggctctcgcccagtatcccctcaagtgcgtgatgccaaggctgaaggggggcaggatcacctcaaggcagtaccgggaatcccaggccttctccttctgcacagcagggcgctgggcagccggcgagccagtggcaagagacggcgcagggctgcaggcggcctggcggaggcagatcaggcagttcagtcgggtcagcccagccgtggctgatgcagttgtcacagccttcccctccccccgccttctgcagcaggcgctggaggcctgcagcacggagcgggagcgcatgggcctcctggccgtggggcctgacctctcccgccgcatctgcctcttcctgaccacagccaaccctgatctcctgctggacctgggctcctga

SEQ ID NO: 9825 - DNA, 4649 bp, Homo sapiens
agtgagcgtggcggccatcttcgtcttctgggcacgtcagctgagccggttagggctgaagaggagcgttgcgcaagcgcacccaagacggtcacaggtaactcccatctgacgagcgaggcgtcgccgtcgtcgccggaagtttggtgtttgcgccgcgggggaggcggcggccgcagcagaagcagctgagtgtctcctgatacccggatgtgaggcgatccgctggcgctagtctgaccctccgccaggcaaaaggaagattgtctttggctatagagtttttttttttaaagattactaaacatacaggaagtgataagaagtatcattcatcagaagcatcattcatcaatcaacttgaagaaaaaggtgatatattatttctttaaggtgctgtgtgatgtgttaagagcatattagaaggaatggttttgtctaattttcttcatgagttatggtggctgagacatcgagtctatattttggggcaaaaactaaacggcagcacaaaaggaaatctatattaatagaatattttgttgaacaaaggaggttagataagaactgcaaaccaacagactcagcaaacaaggaaagaaacgtgttagccataagacatgtttcaagtgaatcgaagtccaataactgtagacttcagaagaaaaaagttttcaaaaattttatcaaaacaggtcactgataaataactcctccagtaatagagctaggcctgaaaccaaaattaattaaaaaattaacaaaacagattgaacctgaattaaatttcttttgataaaaaaacttattaaaaataatcaaaattttcctcaaatttttattaccttgtccaaagtaaagcaagtgtcttttagcattcatgccagcttttctcatgttctaggaatgacagaaaccttacttgaagcaaactagtatttttgttgaaaatgtatatcagcatcagttaaagttgatttttcagacctgctcctcagtaataatactagctagtcagcattcacgcctaccaggacacaaaaatcctcttcaaaactactcagaaaagaaagtcattactcaggaatgatgtccattcaggagaaatcaaaagagaattcctccaaagttactaaaaaaagtgacgataagaattcagaaacagaaattcaggattctcaaaagaatctagcaaaaaaatcaggtccaaaggagactataaaatcacaggctaaatcttccagtgaaagtaaaataaatcagccagaattggaaacacgcatgagtacaaggtcatcaaaggcagcatctaatgataaagctactaaatccattaataaaaatacggtgactgtgaggggatattcacaagaatctacaaaaaagaaattatctcagaaaaaattagtacatgaaaaccctaaagcaaatgaacagcttaaccggagatcacaaaggctacaacaattaacagaggtttcaagaaggtcgttacgcagtagagaaattcagggtcaagttcaagcagttaaacagagtttgccaccaactaaaaaagagcagtgtagcagtactcagagtaaatctaataaaacaagtcaaaaacatgtgaagagaaaagtactggaagtaaagtctgactctaaagaagatgaaaatctagtaattaatgaagtaataaattctcccaaagggaaaaaacgcaaggtagaacatcagacagcttgtgcttgtagttctcaatgcacgcaaggatctgaaaagtgtcctcagaagactactagaagagacgaaacgaaacctgtgcctgtaacttctgaggtgaaaagatcaaaaatggctacttcagtggtcccgaaaaagaatgagatgaagaagtcggttcatacacaagtgaatactaacacaacactcccaaaaagtccacagccatcagtgcctgaacaaagtgataatgagctggagcaagcaggaaagagcaaacgaggtagtattctccagctctgtgaagaaattgctggtgaaattgagtcagataatgtagaggtaaaaaaggaatcttcacaaatggaaagtgtaaaggaagaaaagcccacagaaataaaattggaagagaccagtgttgaaagacaaatacttcatcagaaggaaacaaatcaggatgtgcaatgtaatcgttttttcccaagtagaaaaacaaagcctgtgaaatgtatactaaatggaataaacagctcagccaagaagaactccaactggactaaaattaaactctcaaaatttaactctgtgcagcacaataagttggactctcaagtttcccctaaattaggcttattacgaaccagtttttcaccaccagctttagaaatgcatcatccagtgactcaaagtacgtttttagggacaaagctacatgatagaaatataacttgccagcaggaaaaaatgaaagaaattaattctgaagaagtgaaaattaatgatattacagtagaaattaataaaaccacagaaagggctcctgaaaattgtcatttggccaatgagataaaaccttctgacccaccattggataatcagatgaaacattcttttgattcagcatcaaataagaatttcagccaatgtttggaatccaagctagaaaacagtccagtggaaaatgttactgctgcttcgactctgctcagtcaagcaaaaattgatacaggagagaataaatttccaggttcagctccccaacagcatagtattctcagtaaccagacatctaaaagcagtgataacagggagacaccacgaaatcattctttgcctaagtgtaattcccatttggagataacaattccaaaggacttgaaactaaaagaagcagagaaaactgatgaaaaacagttgattatagatgcaggacaaaaaagatttggagcagtttcttgtaatgtttgtggaatgctgtatacagcttcaaatccagaagatgaaacacagcatctgcttttccacaaccagtttataagtgctgttaaatatgtgggctggaagaaagaaagaattctggctgaataccctgatggcaggataataatggttcttcctgaagacccaaagtatgccctgaaaaaggttgacgagattagagagatggttgacaatgatttaggttttcaacaggctccactaatgtgctattccagaactaaaacacttctcttcatttccaatgacaaaaaagtagttggctgcctaattgcggaacatatccaatggggctacagagttatagaagagaaacttccagttatcaggtcagaagaagaaaaagtcagatttgaaaggcaaaaagcctggtgctgctcaacattaccagagcctgcaatctgcgggatcagtcgaatatgggtattcagcatgatgcgtcggaagaaaattgcttctcgcatgattgaatgcctaaggagtaactttatatatggctcatatttgagcaaagaagaaattgctttctcagatcccactcctgatggaaagctgtttgcaacacagtactgtggcactggtcaatttctggtatataattttattaatggacagaatagcacgtaaaacaaattcttgcctacaccactagaagacatctattgaagagaatggattggttgctgactttaaccaggaactagggccatttttattacaatgaactcaggactggcaacaaccatatggttgttccattttcataaaattggaaacaatgcagtaatagcttattgttttgttttttaaagaagatattttattatcttttacagaaatttatgattgatgtattttatctatagttatttagacatgtttacatgcagcagataattgttcatagtggactgaaaactaatgcaaggactatggtctcagtgataagtatattttgaagttcttaatatggaaatataccagtgtagcttggtactgtatttttttatattgatctgctgataccagtgataggcttaaagattgtattttcacagagtggaaaccaatttttttagttattgttcaaggagggtgcaatattaagtgttttggaatttgaagctaatttttaaaaggcctgaactatactttgaagaaacccctatagaaaaggaaagctccagctaaataggaagaattagaatattgagcttttttttcctgatttttctctttcctatctttgatggaaggaggaagtagaaagtggtaaagaattgaggctttccttcttggagagctgtaaatgacaagcattaggaaaggtaccctcctagattcattattctttcattctggtttcacttttaaaataaatggcaacttggcacacctaggctgttaacaaatctcaaagaggtttataaaaacgtatagaatacttggaagcaaagtatggatgactcggtatctgctttgttattcctcagaaatactgcactgagtatatgccctcattactggacttcattttgatacttgtctatccttcatagtgccctctacttttaaagggtttatatgttgaaaaactgctgtggccttttatgacctgtatataatgtagaataaaaataataaaatacttgatagctttttctaag

SEQ ID NO: 9826 - DNA, 4773 bp, Homo sapiens
agtgagcgtggcggccatcttcgtcttctgggcacgtcagctgagccggttagggctgaagaggagcgttgcgcaagcgcacccaagacggtcacaggtaactcccatctgacgagcgaggcgtcgccgtcgtcgccggaagtttggtgtttgcgccgcgggggaggcggcggccgcagcagaagcagctgagtgtctcctgatacccggatgtgaggcgatccgctggcgctagtctgaccctccgccaggcaaaaggaagattgtctttggctatagagtttttttttttaaagattactaaacatacaggaagtgataagaagtatcattcatcagaagcatcattcatcaatcaacttgaagaaaaaggtgatatattatttctttaaggtgctgtgtgatgtgttaagagcatattagaaggaatggttttgtctaattttcttcatgagttatggtggctgagacatcgagtctatattttggggcaaaaactaaacggcagcacaaaaggaaatctatattaatagaatattttgttgaacaaaggaggttagataagaactgcaaaccaacagactcagcaaacaaggaaagaaacgtgttagccataagacatgtttcaagtgaatcgaagtccaataactgtagacttcagaagaaaaaagttttcaaaaattttatcaaaacaggtcactgataaataactcctccagtaatagagctaggcctgaaaccaaaattaattaaaaaattaacaaaacagattgaacctgaattaaatttcttttgataaaaaaacttattaaaaataatcaaaattttcctcaaatttttattaccttgtccaaagtaaagcaagtgtcttttagcattcatgccagcttttctcatgttctaggaatgacagaaaccttacttgaagcaaactagtatttttgttgaaaatgtatatcagcatcagttaaagttgatttttcagacctgctcctcagtaataatactagctagtcagcattcacgcctaccaggacacaaaaatcctcttcaaaactactcagaaaagaaagtcattactcaggaatgatgtccattcaggagaaatcaaaagagaattcctccaaagttactaaaaaaagtgacgataagaattcagaaacagaaattcaggattctcaaaagaatctagcaaaaaaatcaggtccaaaggagactataaaatcacaggctaaatcttccagtgaaagtaaaataaatcagccagaattggaaacacgcatgagtacaaggtcatcaaaggcagcatctaatgataaagctactaaatccattaataaaaatacggtgactgtgaggggatattcacaagaatctacaaaaaagaaattatctcagaaaaaattagtacatgaaaaccctaaagcaaatgaacagcttaaccggagatcacaaaggctacaacaattaacagaggtttcaagaaggtcgttacgcagtagagaaattcagggtcaagttcaagcagttaaacagagtttgccaccaactaaaaaagagcagtgtagcagtactcagagtaaatctaataaaacaagtcaaaaacatgtgaagagaaaagtactggaagtaaagtctgactctaaagaagatgaaaatctagtaattaatgaagtaataaattctcccaaagggaaaaaacgcaaggtagaacatcagacagcttgtgcttgtagttctcaatgcacgcaaggatctgaaaagtgtcctcagaagactactagaagagacgaaacgaaacctgtgcctgtaacttctgaggtgaaaagatcaaaaatggctacttcagtggtcccgaaaaagaatgagatgaagaagtcggttcatacacaagtgaatactaacacaacactcccaaaaagtccacagccatcagtgcctgaacaaagtgataatgagctggagcaagcaggaaagagcaaacgaggtagtattctccagctctgtgaagaaattgctggtgaaattgagtcagataatgtagaggtaaaaaaggaatcttcacaaatggaaagtgtaaaggaagaaaagcccacagaaataaaattggaagagaccagtgttgaaagacaaatacttcatcagaaggaaacaaatcaggatgtgcaatgtaatcgttttttcccaagtagaaaaacaaagcctgtgaaatgtatactaaatggaataaacagctcagccaagaagaactccaactggactaaaattaaactctcaaaatttaactctgtgcagcacaataagttggactctcaagtttcccctaaattaggcttattacgaaccagtttttcaccaccagctttagaaatgcatcatccagtgactcaaagtacgtttttagggacaaagctacatgatagaaatataacttgccagcaggaaaaaatgaaagaaattaattctgaagaagtgaaaattaatgatattacagtagaaattaataaaaccacagaaagggctcctgaaaattgtcatttggccaatgagataaaaccttctgacccaccattggataatcagatgaaacattcttttgattcagcatcaaataagaatttcagccaatgtttggaatccaagctagaaaacagtccagtggaaaatgttactgctgcttcgactctgctcagtcaagcaaaaattgatacaggagagaataaatttccaggttcagctccccaacagcatagtattctcagtaaccagacatctaaaagcagtgataacagggagacaccacgaaatcattctttgcctaagtgtaattcccatttggagataacaattccaaaggacttgaaactaaaagaagcagagaaaactgatgaaaaacagttgattatagatgcaggacaaaaaagatttggagcagtttcttgtaatgtttgtggaatgctgtatacagcttcaaatccagaagatgaaacacagcatctgcttttccacaaccagtttataagtgctgttaaatatgtggttctgctcattaatcaccacgagtgtggatctgaagaagagtttattacctctctttttttgagtatgtttaacttcagatacacacaacgtagcttctccttccctattagattcttagaagggctggaagaaagaaagaattctggctgaataccctgatggcaggataataatggttcttcctgaagacccaaagtatgccctgaaaaaggttgacgagattagagagatggttgacaatgatttaggttttcaacaggctccactaatgtgctattccagaactaaaacacttctcttcatttccaatgacaaaaaagtagttggctgcctaattgcggaacatatccaatggggctacagagttatagaagagaaacttccagttatcaggtcagaagaagaaaaagtcagatttgaaaggcaaaaagcctggtgctgctcaacattaccagagcctgcaatctgcgggatcagtcgaatatgggtattcagcatgatgcgtcggaagaaaattgcttctcgcatgattgaatgcctaaggagtaactttatatatggctcatatttgagcaaagaagaaattgctttctcagatcccactcctgatggaaagctgtttgcaacacagtactgtggcactggtcaatttctggtatataattttattaatggacagaatagcacgtaaaacaaattcttgcctacaccactagaagacatctattgaagagaatggattggttgctgactttaaccaggaactagggccatttttattacaatgaactcaggactggcaacaaccatatggttgttccattttcataaaattggaaacaatgcagtaatagcttattgttttgttttttaaagaagatattttattatcttttacagaaatttatgattgatgtattttatctatagttatttagacatgtttacatgcagcagataattgttcatagtggactgaaaactaatgcaaggactatggtctcagtgataagtatattttgaagttcttaatatggaaatataccagtgtagcttggtactgtatttttttatattgatctgctgataccagtgataggcttaaagattgtattttcacagagtggaaaccaatttttttagttattgttcaaggagggtgcaatattaagtgttttggaatttgaagctaatttttaaaaggcctgaactatactttgaagaaacccctatagaaaaggaaagctccagctaaataggaagaattagaatattgagcttttttttcctgatttttctctttcctatctttgatggaaggaggaagtagaaagtggtaaagaattgaggctttccttcttggagagctgtaaatgacaagcattaggaaaggtaccctcctagattcattattctttcattctggtttcacttttaaaataaatggcaacttggcacacctaggctgttaacaaatctcaaagaggtttataaaaacgtatagaatacttggaagcaaagtatggatgactcggtatctgctttgttattcctcagaaatactgcactgagtatatgccctcattactggacttcattttgatacttgtctatccttcatagtgccctctacttttaaagggtttatatgttgaaaaactgctgtggccttttatgacctgtatataatgtagaataaaaataataaaatacttgatagctttttctaag

SEQ ID NO: 9827 - DNA, 3922 bp, Homo sapiens
agatttttcacctcaccagggcgcgagaatcttggaaacagccaccagggtgggcggggcaagggctggtgctccaccaatcaccgagccagcccctggaagcgctgagccgtggccaatcggaacgcagcggcttcctcctagcctggcgcgcgattatttgaagacgctcacggagcggctggctaggctgaggagagctcgccgggctctgaggcgcaggaattcaataaagaaaatggcagctcttactccaaggaagaggaagcaggattctttgaagtgtgacagccttttacacttcactgaaaatctgtttccatcacctaataaaaagcactgtttttatcaaaacagtgataaaaatgaagaaaacctgcattgctctcaacaagagcattttgttttaagtgcgctcaaaacaactgaaataaatagactgccatcagcaaatcaaggctcaccatttaaatctgcgctctccactgtatctttttacaaccaaaataagtggtacctcaatccactggagagaaagctgataaaagagagtagatctacttgtctaaaaactaatgatgaagataaatcttttcccattgtgacagaaaaaatgcaaggaaaaccagtctgctccaagaagaacaacaaaaaaccacagaagagtttaactgctaagtatcaaccaaagtatagacacatcaagcctgtatcaaggaattctagaaattccaagcaaaatcgagtgatctataagccaattgtggagaaggaaaataattgtcattcagctgaaaataattccaatgctcctcgggttctgagccaaaaaataaaaccacaagttacactccagggtggagcagcattttttgttagaaaaaaatcttctcttagaaaatcgtccctggaaaatgagccgtcactgggacgcacccaaaagagtaaatcagaagtcattgaagattctgatgtagagactgtcagtgaaaaaaaaacttttgcgacaaggcaagtgccaaagtgcttggtcctagaagagaaattgaaaattggactactgagtgcaagcagtaaaaataaagagaaattaataaaggattcatcagatgacagagtttcttcaaaggaacataaagttgataaaaatgaggctttttcttcagaggattctcttggtgagaataagacaatttctcctaagtccactgtctatccaatcttcagtgcatcttcagtcaattcaaaaagatctttaggtgaagaacagttttctgtgggatctgtcaacttcatgaaacagaccaatatccagaaaaatactaataccagagatacaagtaaaaaaacaaaagaccagctcatcatcgacgctggtcagaaacattttggggctactgtgtgcaagtcttgtggtatgatatatactgcttccaaccctgaagatgaaatgcagcatgtacagcatcaccacaggtttctggaaggaatcaaatatgtgggttggaagaaagaacgtgtagtagcagagttttgggatgggaaaatcgtgttggttctgccacatgatccaagctttgctatcaaaaaggtagaagatgtccaagaacttgttgataatgaattgggcttccagcaagttgttcctaaatgtccaaacaaaataaaaacttttctttttatatctgatgaaaagagagtagttgggtgtttaattgcagaacccatcaaacaggcatttcgtgtcctgtctgaaccaattggtccagaatccccaagctctacggaatgtcctagggcttggcaatgttcagatgtaccagaacctgcagtctgtgggataagtagaatctgggttttcagactgaagagaagaaagcgcattgcaagacgactggttgataccctcaggaattgcttcatgtttggctgttttctcagcactgatgaaatagcattttctgacccaacaccagatggcaagttatttgcaaccaagtactgcaacacccctaatttcctcgtatataattttaatagttaaagctgatttcagttataaaggagttactatctggataagttcaaagagctccttattataaaatacaaactatttaatatcaaaataaaaaataccgagactcacactcatacacacacacacacacacgcacacacacatatcacagttttgttccttatgagttgaaaagtcaggaataaatttgttgaaaattatctggggattcaaaggaaaaatctttgggtgattccctgattagcactctgaatgtttaattatgaaactttgtagctataactggaaaattacctgactctttgtaagagtattaaatacaaagtgatttttctctagaaatgtgacctggtcttttataaagcccactcttagaccaggattatctaatgccacatcagaagcaaacaggcaaatttaaacttgggcaagtaatttctgtgcccaatttgtaaagggaattcctgaatttttttttttttttaatagaggcatgggtctcactgtgttgcccaggctggtctgaaacttttgggctcaagcgatcctcccaaaacgctgggattacagtcatgagccaccgtgcccagcctaattcctgacttctctatacagagtcttcacttgataggcactcgtctgtagtaactcagtttgaatatctttagaaaatgtttagaatttatttgtaacaagatggtaaggaataagattatcccatatgcatttctgtagagcagaatttgatagcttagtgttcaatctttttgaaaataaatgtttacctgtcatcagatttaattaaaattatacttagtaattgcactattacttagttaatttttgttgtatggaaatattggtagtactactttgggaacctgttactgacaattgatgtcattaacaaaatgcctagttggattagatgttttcattttctaattttttgcttgtttaaaatgcaccttacttgttctgagatacctggcaaaagtctttacaaaatgtatggtaatagaaccaaggttagtaaatatacataggctggtggatgagagaccatggaactgtgtaaatacacttaaatgttcacacatttttctagtgtaattcttggatactttaaaaagcaaaacattgttcaaattgttttgattctgaaaaatcattcaactgctaactggcaataagactctaggcaagtcgttttccagattgtaattatatgtagaaactattcatctgcattcattttatttgcctgtaagttaacatgtttccaaaatttaaaagcctgggtccccaaaagaatgtggaagtattaaaatgtatgtaattatgcaaacattttaatgctattttctgcacttatttcttttaaatattttatttaaaatttttaattaacattttgtttgcttaatgcttttgttatgaatcaattaaaattctttattttatacaactaaatctgattttaattattttattatgaaaatagtatatgttaaataaaattcagataatacagaaatagagattgccaaaagaagaggcttcccggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaggcgagcttgcagtgagccgagattgcgccactgcagtccgcagtccggcctgggcgacagagcgagactccgtctcaaaaaaaaaaaaaaaaaaaaaaaaaaaaa

SEQ ID NO: 9828 - DNA, 2487 bp, Homo sapiens
gctcacggagcggctggctaggctgaggagagctcgccgggctctgaggcgcaggaattcaataaagaaaatggcagctcttactccaaggaagaggaagcaggattctttgaagtgtgacagccttttacacttcactgaaaatctgtttccatcacctaataaaaagcactgtttttatcaaaacagtgataaaaatgaagaaaacctgcattgctctcaacaagagcattttgttttaagtgcgctcaaaacaactgaaataaatagactgccatcagcaaatcaaggctcaccatttaaatctgcgctctccactgtatctttttacaaccaaaataagtggtacctcaatccactggagagaaagctgataaaagagagtagatctacttgtctaaaaactaatgatgaagataaatcttttcccattgtgacagaaaaaatgcaaggaaaaccagtctgctccaagaagaacaacaaaaaaccacagaagagtttaactgctaagtatcaaccaaagtatagacacatcaagcctgtatcaaggaattctagaaattccaagcaaaatcgagtgatctataagccaattgtggagaaggaaaataattgtcattcagctgaaaataattccaatgctcctcgggttctgagccaaaaaataaaaccacaagttacactccagggtggagcagcattttttgttagaaaaaaatcttctcttagaaaatcgtccctggaaaatgagccgtcactgggacgcacccaaaagagtaaatcagaagtcattgaagattctgatgtagagactgtcagtgaaaaaaaaacttttgcgacaaggcaagtgccaaagtgcttggtcctagaagagaaattgaaaattggactactgagtgcaagcagtaaaaataaagagaaattaataaagatctttaggtgaagaacagttttctgtgggatctgtcaacttcatgaaacagaccaatatccagaaaaatactaataccagagatacaagtaaaaaaacaaaagaccagctcatcatcgacgctggtcagaaacattttggggctactgtgtgcaagtcttgtggtatgatatatactgcttccaaccctgaagatgaaatgcagcatgtacagcatcaccacaggtttctggaaggaatcaaatatgtgggttggaagaaagaacgtgtagtagcagagttttgggatgggaaaatcgtgttggttctgccacatgatccaagctttgctatcaaaaaggtagaagatgtccaagaacttgttgataatgaattgggcttccagcaagttgttcctaaatgtccaaacaaaataaaaacttttctttttatatctgatgaaaagagagtagttgggtgtttaattgcagaacccatcaaacaggcatttcgtgtcctgtctgaaccaattggtccagaatccccaagctctacggaatgtcctagggcttggcaatgttcagatgtaccagaacctgcagtctgtgggataagtagaatctgggttttcagactgaagagaagaaagcgcattgcaagacgactggttgataccctcaggaattgcttcatgtttggctgttttctcagcactgatgaaatagcattttctgacccaacaccagatgattgtagaagattaaataggtaccaggagacatgaaagaatcatcttcaacatttctcaagtagctgctgattatctccttttatggaggcataacaagctcctggaggcttctacagattctaaagggaaagatttcctgggaggttggtaaatattcaagaagctggtcagttggcagctgttttatagattccttgggattttctacctaaacaacatatcaactgcaaacggggacagtttcgtctcctttccaattttgccttctccattttcttgccttattttagtggctagggctataggactgctaaataaaactggcaagagcaggcatcctggtcttgttccctacttcagtatgatacctgcaggtttttcttgtagacagcctttttcaagctaagatcccttctatttctagttagctgagaggttaactagattttaaactaacttttaaatcaagaatggatgttggattttgtcaaacactttttcggtatctattgagatatgtagttttcaaatttgattaaagacttaaatgttggacctaaaaccataaaaaccctagaagaaaacctaggcaataccattcaggacataggcatgggcaacgacttcatgattaaaacaccaaaagcaatggcagcaaaagccaaaacagacaaatgggatctaattaaagagcttctgcacagcaaaagaaagtaccatcaaagtgaacaggcaacctacagaatgggagaacatttttgcaatcgacctatctgacaaagggctaatatccagaatctacaaagaactcaaacaaatttacaag

SEQ ID NO: 9829 - DNA, 1192 bp, Homo sapiens
aaagcgagagtgagtgggaccggaggggcggggcatcatatgggcggggctgaggcgaggccccggcggccatcttgagccccgccttttacttcggcccgcttcttctggtcactccgccaccgtagaatcgcctaccatttggtgcaagcaaaaagcaatcagcaattggacaggaaaagaatggcattgaagcagatttccagcaacaagtgctttgggggattgcagaaagtttttgaacatgacagtgttgaactaaactgcaaaatgaaatttgctgtctacttaccaccaaaggcagaaacaggaaagtgccctgcactgtattggctctcaggtttaacttgcacagagcaaaattttatatcaaaatctggttatcatcagtctgcttcagaacatggtcttgttgtcattgctccagataccagccctcgtggctgcaatattaaaggtgaagatgagagctgggactttggcactggtgctggattttatgttgatgccactgaagatccttggaaaaccaactacagaatgtactcttatgtcacagaggagcttccccaactcataaatgccaattttccagtggatccccaaaggatgtctatttttggccactccatgggaggtcatggagctctgatctgtgctttgaaaaatcctggaaaatacaaatctgtgtcagcatttgctccaatttgcaaccctgtactctgtccctggggcaaaaaagcctttagtggatatttgggaacagatcaaagtaaatggaaggcttatgatgctacccaccttgtgaaatcctatccaggatctcagctggacatactaattgatcaagggaaagatgaccagtttcttttagatggacagttactccctgataacttcatagctgcctgtacagaaaagaaaatccccgttgtttttcgattgcaagagggttatgatcatagctactacttcattgcaacctttattactgaccacatcagacatcatgctaaatacctgaatgcatgaaaaaactccaaataagagaatctcttcaggattataaaagttgtaaaatgcaactgtattgctgagcaaaaaaaaaaaaaattcaaaacattggattttatagtgctaaaagggctttattctatagttgaatcacctctgaataaagatataaaaccta

SEQ ID NO: 9830 - DNA, 2379 bp, Homo sapiens
gtgcagcattcgccatgctccgctcacgcgtgggagactgggctgtggggtaccggcccggaaagcacgcagcctccaaagccgccttcctcagggaaatttgcgtgaccttactgccctccgtctacaggccttgtacctctccaggccgatttttccacaatttaaatctcagttcacctggtatccagctccagcaacttagagcgtttcacgtcacgccgggcgccaggcgtcggcttgtataacctgaaaacgctcctgtttttctcatctgtgcagtgggttttgattcccaccatggccatcacccagtttcggttatttaaattttgtacctgcctagcaacagtattctcattcctaaagagattaatatgcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgccttttattcatcagtcttctgaattaggtgacttagatacctggcaggaaaataccaatgcatgggaagaagaagaagatgcagcctggcaagcagaagaagttctgagacagcagaaactagcagacagagaaaagagagcagccgaacaacaaaggaagaaaatggaaaaggaagcacaacggctaatgaagaaggaacaaaacaaaattggtgtgaaactttcataacacatgttcaaattttatcatgccagtaggagaaatctcagctccacaacccaagcaacatttgtatggatttaagagtattttaagaagacatactgcttgattttaatacattgatcaggccatccaggacaccacgattctcccaaagtaccttgaactcttagtgattgagactcaaaaaaacaaaaaagacttgagacaatgttttcttcaacatgctccaaatataagacatttgtttgctgtacagaaagtatcacaaatggaatatatcagtacctctcaagctagtgtttctagctaaataaatgggtgtatataattttatggtggaaaagaactgtactgtctgttatgatttccttcaatgtgcataatgataaaataaataattttaatattcttttgtttccatggttacctgacctaaattagataaattgtagggctttagctttcttatttttgtcaaaagttggtgttgacatacattccctctaatttgaactggtattgtttacgtttgatacaacattaaggaatttgatgattttcatttcatgaaaatgacattaaatgcaataattttacttatcataaacattttgtacatcattattttcttttggattagtgttgtcatacatgtaatttatatcacatgtataaacattgaaaatcaactaaaatgacatttgttctacattataacttgtgagtttcaagaactagtattagtagttttttcctttcattatagattgtaagatgttgtggtatctttgagtgccttagttcttccttcctcccaaaagccattaatttacaaatgcttaaagccatcaggtcaaatatttcaaagcctttagatgatttctgtactagctttagatgtctgacgttatgtaggttacctgtgttcttggctaggaaaacattattgattcattaaatcataaaggtgggaataataatcttttatttatgatgttgattggctccaaaatagtcttaaggaaataaatactgggtctgtaggggaaaagtagacttcatagtttaaaatcccattaaccttttcaccgcagttgaaatgcatccagcctgattttcctatcattttggaatttttaaggatttttactttcttaagttactgcctagaatcaacattcggtgagattttgaaatgtcatagatactgtacaggccaaaccttactaatttattttacttaaagtgatattttatagaaaaatcataagttatacaatgagaaccctttaagcccttagcctaagctttcagactaaatgtgattatagaataagatgaaagttaactttggtacagagctttttatagccccaaattatatttccagttattatattcattagaatttctgctaataaactcccaacttaaatagaa

SEQ ID NO: 9831 - DNA, 1467 bp, Homo sapiens
gatgaaggggcggccatggcagctgcgcagaggcaacgcaggctgctacggagcgcgcgcccggctttgaatgagcggggctgggagtgagcgggcggagcgcgagctcgaggaagagacaggcagcgcgcgtgagcgcgccttgtgtgcgcgcgcggcccgcggcagctcggagcctccgccgggcgggcggggagggggaggggcaggttttgattcccaccatggccatcacccagtttcggttatttaaattttgtacctgcctagcaacagtattctcattcctaaagagattaatatgcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgccttttattcatcagtcttctgaattaggtgacttagatacctggcaggaaaataccaatgcatgggaagaagaagaagatgcagcctggcaagcagaagaagttctgagacagcagaaactagcagacagagaaaagagagcagccgaacaacaaaggaagaaaatggaaaaggaagcacaacggctaatgaagaaggaacaaaacaaaattggtgtgaaactttcataacacatgttcaaattttatcatgccagtaggagaaatctcagctccacaacccaagcaacatttgtatggatttaagagtattttaagaagacatactgcttgattttaatacattgatcaggccatccaggacaccacgattctcccaaagtaccttgaactcttagtgattgagactcaaaaaaacaaaaaagacttgagacaatgttttcttcaacatgctccaaatataagacatttgtttgctgtacagaaagtatcacaaatggaatatatcagtacctctcaagctagtgtttctagctaaataaatgggtgtatataattttatggtggaaaagaactgtactgtctgttatgatttccttcaatgtgcataatgataaaataaataattttaatattcttttgtttccatggttacctgacctaaattagataaattgtagggctttagctttcttatttttgtcaaaagttggtgttgacatacattccctctaatttgaactggtattgtttacgtttgatacaacattaaggaatttgatgattttcatttcatgaaaatgacattaaatgcaataattttacttatcat

SEQ ID NO: 9832 - DNA, 706 bp, Homo sapiens
atggcacagaatgttcgattttactaccagctctcacactccgcttctgtttccccttctcttacgggccgctgctcaaacctttatttatcaaatttaagttttgattcccaccatggccatcacccagtttcggttatttaaattttgtacctgcctagcaacagtattctcattcctaaagagattaatatgcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgccttttattcatcagtcttctgaattaggtgacttagatacctggcaggaaaataccaatgcatgggaagaagaagaagatgcagcctggcaagcagaagaagttctgagacagcagaaactagcagacagagaaaagagagcagccgaacaacaaaggaagaaaatggaaaaggaagca

SEQ ID NO: 9833 - DNA, 777 bp, Homo sapiens
atggccatcacccagtttcggttatttaaattttgtacctgcctagcaacagtattctcattcctaaagagattaatatgcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatgggaatgtggcaacacaacaaaattctttggaacaactggaacctgactattttaaggacatgacaccaactattaggaaaactcagaaaattgttattaagaagagagaaccattgaattttggcatcccagatgggagcacaggtttctctagtagattagcagctacacaagatctgccttttattcatcagtcttctgaattaggtgacttagatacctggcaggaaaataccaatgcatgggaagaagaagaagatgcagcctggcaagcagaagaagttctgagatccaggaccaatgtatgtttactctgctctctcctgtttcatcatcccactcctacctccactccctacattaaccaatcagtaaagatagagagagtgagtctgggtcagtggagttacggaaagagtaaggaacagcagaaactagcagacagagaaaagagagcagccgaacaacaaaggaagaaaatggaaaaggaagcacaacggctaatgaagaaggaacaaaacaaaattggtgtgaaactttcataa

SEQ ID NO: 9834 - DNA, 813 bp, Homo sapiens
ggtactcctaggtattggcatttctttaatagattcccagatttgtgaaccactggactaaatgagctccatggtaactttcaatttactagctatgtgactttggtcaagttatttgacctctcttaattcaatttcctcatctataaaatggatataaggaaatatattcatctgcaagttaaaaatatttaaagtattttaaatagtattatgttcatgtggttcaaactttaaaaggtacacagagatttaatatattctattttatacttttttattttttgaattgtagatttttgtattaatagatttaggtaaaattattttcaaaaactcagaatgaagggttttatccttacaaccattgaaaactcgaaaacctggtttttgacttgttaatatgatttaaattataattttaaaatttactgtgttatagtttctagagaaaggtaaaaaatatcttagatttttcttagtgcataataggtcttttcaggacaggagtatgacttttgaaatcaatttaatgcattttttgttttgtgcctcttccacaggttttgattcccaccatggccatcacccagtttcggttatttaaattttgtacctgcctagcaacagtattctcattcctaaagagattaatatgcagatctggcagaggacggaaattaagtggagaccaaataactttgccaactacagttgattattcatcagttcctaagcagacagatgttgaagagtggacttcctgggatgaagatgcacccaccagtgtaaagatcgaaggagggaatggga

SEQ ID NO: 9835 - DNA, 2215 bp, Homo sapiens
aagcagccggcggcgccgccgagtgaggggacgcggcgcggtggggcggcgcggcccgaggaggcggcggaggaggggccgcccgcggcccccggctcactccggcactccgggccgctcggcccccatgcctgcccgaccgcgctgccggagccccaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccaggggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttgactgtacagagactctattttaatgtatatttgctgcaaagagaaaccgcttttggttttaaacctttaatgagaaaaaaatatataataccgagctc

SEQ ID NO: 9836 - DNA, 2283 bp, Homo sapiens
tagaggtctcccgcgggcggggagggggaggcgtagcaactttaggcaacttcccaaaggtgtgcgcaggttgggggcgggacgcggcgccccgggaggtggcggcctctgcgacagcgggagtataagagtggacctgcaggctggtcgcgaggaggtggagcggcgcccgccgtgtgcctgggaccggcatgctggggcaggagggcagccgcgtgtcaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccaggggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagcagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttgactgtacagagactctattttaatgtatatttgctgcaaagagaaaccgcttttggttttaaacctttaatgagaaaaaaatatataataccgagctcaaaaa

SEQ ID NO: 9837 - DNA, 2218 bp, Homo sapiens
tcctacaagcagccggcggcgccgccgagtgaggggacgcggcgcggtggggcggcgcggcccgaggaggcggcggaggaggggccgcccgcggcccccggctcactccggcactccgggccgctcggcccccatgcctgcccgaccgcgctgccggagccccaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccaggggagcatcgagtacagctgtccggcctccaacgagtgtgagatcaccaagcggagacgcaaggcctgccaggcctgccgcttcaccaagtgcctgcgggtgggcatgctcaaggagggagtgcgcctggaccgcgtccggggtgggcggcagaagtacaagcggcggccggaggtggacccactgcccttcccgggccccttccctgctgggcccctggcagtcgctggaggcccccggaagacagccccagtgaatgcactggtgtctcatctgctggtggttgagcctgagaagctctatgccatgcctgaccccgcaggccctgatgggcacctcccagccgtggctaccctctgtgacctctttgaccgagagattgtggtcaccatcagctgggccaagagcatcccaggcttctcatcgctgtcgctgtctgaccagatgtcagtactgcagagcgtgtggatggaggtgctggtgctgggtgtggcccagcgctcactgccactgcaggatgagctggccttcgctgaggacttagtcctggatgaagagggggcacgggcagctggcctgggggaactgggggctgccctgctgcaactagtgcggcggctgcaggccctgcggctggagcgagaggagtatgttctactaaaggccttggcccttgccaattcagactctgtgcacatcgaagatgccgaggctgtggagcagctgcgagaagctctgcacgaggccctgctggagtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttgactgtacagagactctattttaatgtatatttgctgcaaagagaaaccgcttttggttttaaacctttaatgagaaaaaaatatataataccgagctc

SEQ ID NO: 9838 - DNA, 742 bp, Homo sapiens
caggtgtgaaaagctctggaggtgttttcatgagtccgtgcctgtgcgtgtggatgtggggagacctagtgagagtgtgtgtgatcatgagccttgactgagttcgtggatggggtgtgcgctccaggagaagtgtgtgagcacaagtgtgagcaggagtgagcacgggtttgggaaggccggtgcaagtgtgaaagccctcagcagagagcgagcctgcgtgggcttgtggggctcctgagcaccccggtgagtggagtgtgtgaactcggtgtgagcacgtccactggccttgggtctgctctccaatgcagaatacccagatgagggcagggtctcagaggtccccccaacatctggagaaaactgggaagtatcctgctcctggctagggattccaggtgaccagcgccatgtccagccaggtggtgggcattgagcctctctacatcaaggcagagccggccagccctgacagtccaaagggttcctcggagacagagaccgagcctcctgtggccctggcccctggtccagctcccactcgctgcctcccaggccacaaggaagaggaggatggggagggggctgggcctggcgagcagggcggtgggaagctggtgctcagctccctgcccaagcgcctctgcctggtctgtggggacgtggcctccggctaccactatggtgtggcatcctgtgaggcctgcaaagccttcttcaagaggaccatccagggtga

SEQ ID NO: 9839 - DNA, 1794 bp, Homo sapiens
tttaggccagaggtgatccagtgatttgggagctgcaggtcacacaggctgctcagagggctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccactacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaaggtgtgcgccttgatcgagtgcgtggaggccgtcagaaatacaagcgacggctggactcagagagcagcccatacctgagcttacaaatttctccacctgctaaaaagccattgaccaagattgtctcatacctactggtggctgagccggacaagctctatgccatgcctccccctggtatgcctgagggggacatcaaggccctgaccactctctgtgacctggcagaccgagagcttgtggtcatcattggctgggccaagcacatcccaggcttctcaagcctctccctgggggaccagatgagcctgctgcagagtgcctggatggaaatcctcatcctgggcatcgtgtaccgctcgctgccctatgacgacaagctggtgtacgctgaggactacatcatggatgaggagcactcccgcctcgcggggctgctggagctctaccgggccatcctgcagctggtacgcaggtacaagaagctcaaggtggagaaggaggagtttgtgacgctcaaggccctggccctcgccaactccgattccatgtacatcgaggatctagaggctgtccagaagctgcaggacctgctgcacgaggcactgcaggactacgagctgagccagcgccatgaggagccctggaggacgggcaagctgctgctgacactgccgctgctgcggcagacggccgccaaggccgtgcagcacttctatagcgtcaaactgcagggcaaagtgcccatgcacaaactcttcctggagatgctggaggccaaggcctgggccagggctgactcccttcaggagtggaggccactggagcaagtgccctctcccctccaccgagccaccaagaggcagcatgtgcatttcctaactcccttgccccctcccccatctgtggcctgggtgggcactgctcaggctggataccacctggaggttttccttccgcagagggcaggttggccaagagcagcttagaggatctcccaaggatgaaagaatgtcaagccatgatggaaaatgccccttccaatcagctgccttcacaagcagggatcagagcaactccccggggatccccaatccacgcccttctagtccaacccccctcaatgagagaggcaggcagatctcacccagcactaggacaccaggaggccagggaaagcatctctggctcaccatgtaacatctggc

SEQ ID NO: 9840 - DNA, 2713 bp, Homo sapiens
tttaggccagaggtgatccagtgatttgggagctgcaggtcacacaggctgctcagagggctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccactacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaaggtgtgcgccttgatcgagtgcgtggaggccgtcagaaatacaagcgacggctggactcagagagcagcccatacctgagcttacaaatttctccacctgctaaaaagccattgaccaagattgtctcatacctactggtggctgagccggacaagctctatgccatgcctccccctggtatgcctgagggggacatcaaggccctgaccactctctgtgacctggcagaccgagagcttgtggtcatcattggctgggccaagcacatcccaggcttctcaagcctctccctgggggaccagatgagcctgctgcagagtgcctggatggaaatcctcatcctgggcatcgtgtaccgctcgctgccctatgacgacaagctggtgtacgctgaggactacatcatggatgaggagcactcccgcctcgcggggctgctggagctctaccgggccatcctgcagctggtacgcaggtacaagaagctcaaggtggagaaggaggagtttgtgacgctcaaggccctggccctcgccaactccgattccatgtacatcgaggatctagaggctgtccagaagctgcaggacctgctgcacgaggcactgcaggactacgagctgagccagcgccatgaggagccctggaggacgggcaagctgctgctgacactgccgctgctgcggcagacggccgccaaggccgtgcagcacttctatagcgtcaaactgcagggcaaagtgcccatgcacaaactcttcctggagatgctggaggccaaggttggccaagagcagcttagaggatctcccaaggatgaaagaatgtcaagccatgatggaaaatgccccttccaatcagctgccttcacaagcagggatcagagcaactccccggggatccccaatccacgcccttctagtccaacccccctcaatgagagaggcaggcagatctcacccagcactaggacaccaggaggccagggaaagcatctctggctcaccatgtaacatctggcttggagcaagtgggtgttctgcacaccaggcagctgcacctcactggatctagtgttgctgcgagtgacctcacttcagagcccctctagcagagtggggcggaagtcctgatggttggtgtccatgaggtggaagctgcttttatacttaaaactcagatcacaacaggaaatgtgtcagtaacaatggaactccatccaatgggaaagttcctggtactgaaggggtccattggacactcagaaaagaagttcaggggccaacttcttagctggaatcctggccagatgaggaccctctccggggaagggagaggactgacttagtggaaggtggtgaagtgaggagagtttaggggaaccttcccccagtggaacagatctcaagtttaccctaaacctgccatttctggaaaatctgtaaagaggaaacagcctgtctcagctgtactctcatgatacaggtcatttgaaatgaaccaagaaataaaacatgaaaatccaaccatggagaaggtggtatggctgggttttgtttggtccccttgtccttatacgttctaaagtttccagactggctttgtcactttgtgaactcgtcatgtgtgaaaaccaatctttgcatatagggaacttcctcgggccacactttaagaaccaagtaagaggctctcaagactccagcagagtcgggaggccatggcagcgccttagaggagctggaacctgcacccacctgtgtcggtggggggggcctcctttccccatagactctgccctccctctgtgcagatggaagtggcaggggagggtgaccagcttgtgacaagaagactgaagggtccagagtccatgctcacggaacagcaccaaagaaaagcactatgtggaaagattgttttattttctaataatgataatatggctggaatggcttcttaagatgtatatattttttaaaatggcagttccccattgcagcatcacctacttgtatgtctttctgcctctgtatatgttctcccagaaacccccatgtaaatcaaatgccctaggatgcttccatcctggtcccatgtatctggaatctaataaataaggaaagg

SEQ ID NO: 9841 - DNA, 2432 bp, Homo sapiens
ttcaggaaaagccatcatgtttccgcagcatttatctgtcagcaggagactattatgagagcacaaactcacattgtattagcgttatcagttaattatgatccttgggaccagtgccagccaatgggctagcagtctgctgaccatcactcagggatataactccacacccccaaattcaagcatgtaagaagacagcaggtccgcagagaggtgtggtcagggacatttcccctggccgggagcccatggagcactgtcctcagagatgcgcaggttaggctcactgtctaggccaggcccaccttagtcactgtggactggcaatggaagctcttcctggacacacctgccctagccctcaccctggggtggaagagaaatgagcttggcttgcaactcagaccattccacggaggcatcctccccttcctgggctggtgaataaaagtttcctgaggtcaaggacttccttttccctgccaaaatggtgtccagaactttgaggccagaggtgatccagtgatttgggagctgcaggtcacacaggctgctcagagggctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccactacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaaggtgtgcgccttgatcgagtgcgtggaggccgtcagaaatacaagcgacggctggactcagagagcagcccatacctgagcttacaaatttctccacctgctaaaaagccattgaccaagattgtctcatacctactggtggctgagccggacaagctctatgccatgcctccccctggtatgcctgagggggacatcaaggccctgaccactctctgtgacctggcagaccgagagcttgtggtcatcattggctgggccaagcacatcccaggcttctcaagcctctccctgggggaccagatgagcctgctgcagagtgcctggatggaaatcctcatcctgggcatcgtgtaccgctcgctgccctatgacgacaagctggtgtacgctgaggactacatcatggatgaggagcactcccgcctcgcggggctgctggagctctaccgggccatcctgcagctggtacgcaggtacaagaagctcaaggtggagaaggaggagtttgtgacgctcaaggccctggccctcgccaactccgattccatgtacatcgaggatctagaggctgtccagaagctgcaggacctgctgcacgaggcactgcaggactacgagctgagccagcgccatgaggagccctggaggacgggcaagctgctgctgacactgccgctgctgcggcagacggccgccaaggccgtgcagcacttctatagcgtcaaactgcagggcaaagtgcccatgcacaaactcttcctggagatgctggaggccaaggcctgggccagggctgactcccttcaggagtggaggccactggagcaagtgccctctcccctccaccgagccaccaagaggcagcatgtgcatttcctaactcccttgccccctcccccatctgtggcctgggtgggcactgctcaggctggataccacctggaggttttccttccgcagagggcaggttggccaagagcagcttagaggatctcccaaggatgaaagaatgtcaagccatgatggaaaatgccccttccaatcagctgccttcacaagcagggatcagagcaactccccggggatccccaatccacgcccttctagtccaacccccctcaatgagagaggcaggcagatctcacccagcactaggacaccaggaggccagggaaagcatctctggctcaccatgtaacatctggcttggagcaagtgggtgttctgcacaccaggcagctgcacctcactggatctagtgttgctgcgagtgacctcacttcagagcccctctagcagagtggggcggaagtcctgatggttggtgtccatgaggtggaag

SEQ ID NO: 9842 - DNA, 2144 bp, Homo sapiens
tccctgccaaaatggtgtccagaactttgaggccagaggtgatccagtgatttgggagctgcaggtcacacaggctgctcagagggctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccactacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaaggtgtgcgccttgatcgagtgcgtggaggccgtcagaaatacaagcgacggctggactcagagagcagcccatacctgagcttacaaatttctccacctgctaaaaagccattgaccaagattgtctcatacctactggtggctgagccggacaagctctatgccatgcctccccctggtatgcctgagggggacatcaaggccctgaccactctctgtgacctggcagaccgagagcttgtggtcatcattggctgggccaagcacatcccaggcttctcaagcctctccctgggggaccagatgagcctgctgcagagtgcctggatggaaatcctcatcctgggcatcgtgtaccgctcgctgccctatgacgacaagctggtgtacgctgaggactacatcatggatgaggagcactcccgcctcgcggggctgctggagctctaccgggccatcctgcagctggtacgcaggtacaagaagctcaaggtggagaaggaggagtttgtgacgctcaaggccctggccctcgccaactccgattccatgtacatcgaggatctagaggctgtccagaagctgcaggacctgctgcacgaggcactgcaggactacgagctgagccagcgccatgaggagccctggaggacgggcaagctgctgctgacactgccgctgctgcggcagacggccgccaaggccgtgcagcacttctatagcgtcaaactgcagggcaaagtgcccatgcacaaactcttcctggagatgctggaggccaaggttggccaagagcagcttagaggatctcccaaggatgaaagaatgtcaagccatgatggaaaatgccccttccaatcagctgccttcacaagcagggatcagagcaactccccggggatccccaatccacgcccttctagtccaacccccctcaatgagagaggcaggcagatctcacccagcactaggacaccaggaggccagggaaagcatctctggctcaccatgtaacatctggcttggagcaagtgggtgttctgcacaccaggcagctgcacctcactggatctagtgttgctgcgagtgacctcacttcagagcccctctagcagagtggggcggaagtcctgatggttggtgtccatgaggtggaagctgcttttatacttaaaactcagatcacaacaggaaatgtgtcagtaacaatggaactccatccaatgggaaagttcctggtactgaaggggtccattggacactcagaaaagaagttcaggggccaacttcttagctggaatcctggccagatgaggaccctctccggggaagggagaggactgacttagtggaaggtggtgaagtgaggagagtttaggggaaccttcccccagtggaacagatctcaagtttaccctaaacctgccatttctggaaaatctgtaaagaggaaacagcctgtctcagctgtactctcatgatacaggtcatttgaaatgaaccaagaaataaaacatgaaaatccaaccatgg

SEQ ID NO: 9843 - DNA, 1826 bp, Homo sapiens
catggggctgggtggagttggaagtctagagctttttgctgttttgtttaagacctggttatggttgtgagacttttttttttttttttttttttttgtcagctgcctgttatatcaatcacggagtcgggatctatttataggttgggagtactgtgtccttagtcacaaagagacacagacaggggactgtcagctggtaccggaggagcggagcaacgagttatcagcaactgaaagcacctgaggggccgcacattccaccccagcccagtcctcgtcctccacgccagccccaagcatgctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccactacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaaggtgtgcgccttgatcgagtgcgtggaggccgtcagaaatacaagcgacggctggactcagagagcagcccatacctgagcttacaaatttctccacctgctaaaaagccattgaccaagattgtctcatacctactggtggctgagccggacaagctctatgccatgcctccccctggtatgcctgagggggacatcaaggccctgaccactctctgtgacctggcagaccgagagcttgtggtcatcattggctgggccaagcacatcccaggcttctcaagcctctccctgggggaccagatgagcctgctgcagagtgcctggatggaaatcctcatcctgggcatcgtgtaccgctcgctgccctatgacgacaagctggtgtacgctgaggactacatcatggatgaggagcactcccgcctcgcggggctgctggagctctaccgggccatcctgcagctggtacgcaggtacaagaagctcaaggtggagaaggaggagtttgtgacgctcaaggccctggccctcgccaactccgattccatgtacatcgaggatctagaggctgtccagaagctgcaggacctgctgcacgaggcactgcaggactacgagctgagccagcgccatgaggagccctggaggacgggcaagctgctgctgacactgccgctgctgcggcagacggccgccaaggccgtgcagcacttctatagcgtcaaactgcagggcaaagtgcccatgcacaaactcttcctggagatgctggaggccaaggttggccaagagcagcttagaggatctcccaaggatgaaagaatgtcaagccatgatggaaaatgccccttccaatcagctgccttcacaagcagggatcagagcaactccccggggatccccaatccacgcccttctagtccaacccccctcaatgagagaggcaggcagatctcacccagcactaggacaccaggaggccagggaaagcatc

SEQ ID NO: 9844 - DNA, 1427 bp, Homo sapiens
tttaggccagaggtgatccagtgatttgggagctgcaggtcacacaggctgctcagagggctgctgaacaggatgtcctcggacgacaggcacctgggctccagctgcggctccttcatcaagactgagccgtccagcccgtcctcgggcatcgatgccctcagccaccacagccccagtggctcgtccgacgccagcggcggctttggcctggccctgggcacccacgccaacggtctggactcgccacccatgtttgcaggcgccgggctgggaggcaccccatgccgcaagagctacgaggactgtgccagcggcatcatggaggactcggccatcaagtgcgagtacatgctcaacgccatccccaagcgcctgtgcctcgtgtgcggggacattgcctctggctaccactacggcgtggcctcctgcgaggcttgcaaggccttcttcaagaggactatccaagggaacattgagtacagctgcccggccaccaacgagtgcgagatcaccaaacggaggcgcaagtcctgccaggcctgccgcttcatgaaatgcctcaaagtggggatgctgaaggaaggtgtgcgccttgatcgagtgcgtggaggccgtcagaaatacaagcgacggctggactcagagagcagcccatacctgagcttacaaatttctccacctgctaaaaagccattgaccaagattgtctcatacctactggtggctgagccggacaagctctatgccatgcctccccctggtatgcctgagggggacatcaaggccctgaccactctctgtgacctggcagaccgagagcttgtggtcatcattggctgggccaagcacatcccaggcttctcaagcctctccctgggggaccagatgagcctgctgcagagtgcctggatggaaatcctcatcctgggcatcgtgtaccgctcgctgccctatgacgacaagctggtgtacgctgaggactacatcatggatgaggagcactcccgcctcgcggggctgctggagctctaccgggccatcctgcagctggtacgcaggtacaagaagctcaaggtggagaaggaggagtttgtgacgctcaaggccctggccctcgccaactccgattccatgtacatcgaggatctagaggctgtccagaagctgcaggacctgctgcacgaggcactgcaggactacgagctgagccagcgccatgaggagccctggaggacgggcaagctgctgctgacactgccgctgctgcggcagacggccgccaaggccgtgcagcacttctatagcgtcaaactgcagggcaaagtgcccatgcacaaactcttcctggagatgctggaggccaaggtgtgatggccccgcacacggaccaatgcccacctacagacagacaaacggacagaccg

SEQ ID NO: 9845 - DNA, 1826 bp, Homo sapiens
aagtccttgattaggagagtgtgagagctttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagaacttgaatgagacctgcctcatcagtcatgggatcatagtgtcacagatggaaaagcaactatcagctgaattgtactgaactacacacttggctaattcatcttattgctctacacatctaaaggaaggctcattctgttcttggagtctagacagcatcaggagttgggctcagtgaacaaaactttaatgtctagagcatttatgagggttttaatgattggaaaatctatcctgagaatgtggtcaccatatgtgacagccttgctttctatcttgtcttcagtttctggggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgc

SEQ ID NO: 9846 - DNA, 5197 bp, Homo sapiens
ggttttgtagactttcatagccaaagaaaccggcttcggcttctttaaaatccccgacgactcacctgattaacctgctgcagttctgaccctgccaagagctgacaatttactggttcatcaatgaaacaatattaaattatgaagatgtaaggaaaaaatcctacgctaacactgtcgcagtttgaaaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttt

SEQ ID NO: 9847 - DNA, 5431 bp, Homo sapiens
tatccacacacagcatcggaatattgctagctaactcaacaaatgtgcaaatcaggggactgttgtgtgtgtaccgattcatgtctatactgtttttattggtgaagtaggaaattagtctaaatatttgattctgcagttgcatgtcaccaaattcagtgaggttagatgttaaatcatcttgttggctttgggctgaatttgatctaagagacaaaagtctcaaacaacagactacttactgccaccacatctcgattcaaagaatagttttcacatgttcgtggtgtggaaaggactttctgtttctcactaatttcttcagctataccaagagtggtgttgtctttgaacaggaaggacagcaaaaataaacataacagttttttcataagatacacagctgcattacacatcccaaaattgcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttt

SEQ ID NO: 9848 - DNA, 5216 bp, Homo sapiens
agctgacaatttactggttcatcaatgaaacaatattaaattatgaagatgtaaggaaaaaatcctacgctaacactgtcgcagtttgaaagctttaaaaagttgaagtctattggaaaccttcttataagaaaccttcctagtcagagaattcaactttcttcttttcttcattcatgaaaatgcagatccactgagaaagggaataaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttt

SEQ ID NO: 9849 - DNA, 5352 bp, Homo sapiens
gtgtaagatgtgcaatgttcctgcatgggggttttgtagactttcatagccaaagaaaccggcttcggcttctttaaaatccccgacgactcacctgattaacctgctgcagttctgaccctgccaagagctgacaatttactggttcatcaatgaaacaatattaaattatgaagatgtaaggaaaaaatcctacgctaacactgtcgcagtttgaaagctttaaaaagttgaagtctattggaaaccttcttataagaaaccttcctagtcagagaattcaactttcttcttttcttcattcatgaaaatgcagatccactgagaaagggaataaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttttgactgct

SEQ ID NO: 9850 - DNA, 5274 bp, Homo sapiens
agctgacaatttactggttcatcaatgaaacaatattaaattatgaagatgtaaggaaaaaatcctacgctaacactgtcgcagtttgaaagacttgaatgagacctgcctcatcagtcatgggatcatagtgtcacagatggaaaagcaactatcagctgaattgtactgaactacacacttggctaattcatcttattgctctacacatctaaaggaaggctcattctgttcttggagtctagacagcatcaggagttgggctcaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttt

SEQ ID NO: 9851 - DNA, 5312 bp, Homo sapiens
ggagggcgagggcgggctcctctggaggcggcgggctccaggccgggctccctaaacgggtcagcaattggagcgggaaggccggacagagacagggtcttgctttgtcacccaggctggagtgcagtgccacaatcagagcttactcctgccttgaactcctgggcttcagggatcctgctgcctcggccctccaagcagctgagactacagagctgacaatttactggttcatcaatgaaacaatattaaattatgaagatgtaaggaaaaaatcctacgctaacactgtcgcagtttgaaaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccactttt

SEQ ID NO: 9852 - DNA, 5532 bp, Homo sapiens
aagtccttgattaggagagtgtgagagctttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagaacttgaatgagacctgcctcatcagtcatgggatcatagtgtcacagatggaaaagcaactatcagctgaattgtactgaactacacacttggctaattcatcttattgctctacacatctaaaggaaggctcattctgttcttggagtctagacagcatcaggagttgggctcagtgaacaaaactttaatgtctagagcatttatgagggttttaatgattggaaaatctatcctgagaatgtggtcaccatatgtgacagccttgctttctatcttgtcttcagtttctggggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccattgctctggtctgatcctgcagataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttt

SEQ ID NO: 9853 - DNA, 5216 bp, Homo sapiens
aagtccttgattaggagagtgtgagagctttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagagcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttt

SEQ ID NO: 9854 - DNA, 565 bp, Homo sapiens
agtccttgattaggagagtgtgagagctttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagaacttgaatgagacctgcctcatcagtcatgggatcatagtgtcacagatggaaaagcaactatcagctgaattgtactgaactacacacttggctaattcatcttattgctctacacatctaaaggaaggctcattctgttcttggagtctagacagcatcaggagttgggctcaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggact

SEQ ID NO: 9855 - DNA, 583 bp, Homo sapiens
aactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagatgaacaaaactttaatgtctagagcatttatgagggttttaatgattggaaaatctatcctgagaatgtggtcaccatatgtgacagccttgctttctatcttgtcttcagtttctggggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtg

SEQ ID NO: 9856 - DNA, 1464 bp, Homo sapiens
ctggggtgcacaaataatggttgccggtcgcacatggattcggtagaactttgccttcctgaatctttttccctgcactacgaggaagagtagacttgaatgagacctgcctcatcagtcatgggatcatagtgtcacagatggaaaagcaactatcagctgaattgtactgaactacacacttggctaattcatcttattgctctacacatctaaaggaaggctcattctgttcttggagtctagacagcatcaggagttgggctcagtgaacaaaactttaatgtctagagcatttatgagggttttaatgattggaaaatctatcctgagaatgtggtcaccatatgtgacagccttgctttctatcttgtcttcagtttctggggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcag

SEQ ID NO: 9857 - DNA, 584 bp, Homo sapiens
tttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagactggacaacacctgataccaacaatataatgtcacctctgctatagatcacccaagaccagctgcatttacatccagatgttaactactgcagactaagctattaagagtttaacaaatacaagcactggctgagcttcagaccttccatcgaaatgcagaccactttgaacatcagcacgtgcatgtgggaattcaaactcctgacggttcattcacgatcacacatttacctggatgcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatg

SEQ ID NO: 9858 - DNA, 3015 bp, Homo sapiens
tgacaatttactggttcatcaatgaaacaatattaaattatgaagatgtaaggaaaaaatcctacgctaacactgtcgcagtttgaaaggtccgtgagagaaaagttaattatgatgttatttcaaactttaaaaagttgaagtctattggaaaccttcttataagaaaccttcctagtcagagaattcaactttcttcttttcttcattcatgaaaatgcagatccactgagaaagggaataaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaag

SEQ ID NO: 9859 - DNA, 5304 bp, Homo sapiens
gagggcgagggcgggctcctctggaggcggcgggctccaggccgggctccctaaacgggtcagcaattggagcgggaaggccggacagagctgacaatttactggttcatcaatgaaacaatattaaattatgaagatgtaaggaaaaaatcctacgctaacactgtcgcagtttgaaagctttaaaaagttgaagtctattggaaaccttcttataagaaaccttcctagtcagagaattcaactttcttcttttcttcattcatgaaaatgcagatccactgagaaagggaataaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttt

SEQ ID NO: 9860 - DNA, 2074 bp, Homo sapiens
attctgggcaaagtgtggtgacttgtggattttcactgtgacgatgttgctacacggtccttcacttggagttagtgcaacaaggagacatctgagcttaaaatttatgaaacatctaaagaaatcaagctttatataggatcaccgttgtgggttgaattgtgtatccccaaaagatgttgaagtcctgaccacctccctataccttacaatatagccttttacggaagtagggtctttgcagaagatcaagttaagatgaaatcatttgattgggccctagttcaatatatcttatgtccttataaaaggagacaatttggacacagggacaaggggagaatgccacataaagattggaattatgctgccataagccaaggaactccaaagatcgctggcaagctgctaaaagctagcacagattcatggaacagagtctccgtcatagcctacaaaaggaatcaaccctgctgacatcttgatttcagacttctagcctccagaactagctgacaatttactggttcatcaatgaaacaatattaaattatgaagatgtaaggaaaaaatcctacgctaacactgtcgcagtttgaaaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccatataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttc

SEQ ID NO: 9861 - DNA, 5365 bp, Homo sapiens
aagtccttgattaggagagtgtgagagctttggtcccaactggctgtgcctataggcttgtcactaggagaacatttgtgttaattgcactgtgctctgtcaaggaaactttgatttatagctggggtgcacaaataatggttgccggtcgcacatggattcggtagaactttgccttcctgaatctttttccctgcactacgaggaagaaactgatgtaaagttcccatcatgaatgtaattaggaattgtgcatttagatcctgaatgtggcgagaatgtgattggggtcttggagcagtcaagtctgatctggcctgtgttccttcagctaaaaggcttctctgcagaatgtcaaacaaagatcgacacattgattccagctgttcgtccttcatcaagacggaaccttccagcccagcctccctgacggacagcgtcaaccaccacagccctggtggctcttcagacgccagtgggagctacagttcaaccatgaatggccatcagaacggacttgactcgccacctctctacccttctgctcctatcctgggaggtagtgggcctgtcaggaaactgtatgatgactgctccagcaccattgttgaagatccccagaccaagtgtgaatacatgctcaactcgatgcccaagagactgtgtttagtgtgtggtgacatcgcttctgggtaccactatggggtagcatcatgtgaagcctgcaaggcattcttcaagaggacaattcaaggcaatatagaatacagctgccctgccacgaatgaatgtgaaatcacaaagcgcagacgtaaatcctgccaggcttgccgcttcatgaagtgtttaaaagtgggcatgctgaaagaaggggtgcgtcttgacagagtacgtggaggtcggcagaagtacaagcgcaggatagatgcggagaacagcccatacctgaaccctcagctggttcagccagccaaaaagccattgctctggtctgatcctgcagataacaagattgtctcacatttgttggtggctgaaccggagaagatctatgccatgcctgaccctactgtccccgacagtgacatcaaagccctcactacactgtgtgacttggccgaccgagagttggtggttatcattggatgggcgaagcatattccaggcttctccacgctgtccctggcggaccagatgagccttctgcagagtgcttggatggaaattttgatccttggtgtcgtataccggtctctttcgtttgaggatgaacttgtctatgcagacgattatataatggacgaagaccagtccaaattagcaggccttcttgatctaaataatgctatcctgcagctggtaaagaaatacaagagcatgaagctggaaaaagaagaatttgtcaccctcaaagctatagctcttgctaattcagactccatgcacatagaagatgttgaagccgttcagaagcttcaggatgtcttacatgaagcgctgcaggattatgaagctggccagcacatggaagaccctcgtcgagctggcaagatgctgatgacactgccactcctgaggcagacctctaccaaggccgtgcagcatttctacaacatcaaactagaaggcaaagtcccaatgcacaaactttttttggaaatgttggaggccaaggtctgactaaaagctccctgggccttcccatccttcatgttgaaaaagggaaaataaacccaagagtgatgtcgaagaaacttagagtttagttaacaacatcaaaaatcaacagactgcactgataatttagcagcaagactatgaagcagctttcagattcctccataggttcctgatgagtttctttctactttctccatcatcttctttcctctttcttcccacatttctctttctctttattttttctccttttcttctttcacctcccttatttctttgcttctttcattcctagttcccattctcctttattttcttcccgtctgcctgccttctttcttttctttacctactctcattcctctcttttctcatccttccccttttttctaaatttgaaatagctttagtttaaaaaaaaatcctcccttccccctttcctttccctttctttcctttttccctttccttttccctttcctttcctttcctcttgaccttctttccatctttctttttcttccttctgctgctgaacttttaaaagaggtctctaactgaagagagatggaagccagccctgccaaaggatggagatccataatatggatgccagtgaacttattgtgaaccatactgtccccaatgactaaggaatcaaagagagagaaccaacgttcctaaaagtacagtgcaacatatacaaattgactgagtgcagtattagatttcatgggagcagcctctaattagacaacttaagcaacgttgcatcggctgcttcttatcattgcttttccatctagatcagttacagccatttgattccttaattgttttttcaagtcttccaggtatttgttagtttagctactatgtaactttttcagggaatagtttaagctttattcattcatgcaatactaaagagaaataagaatactgcaattttgtgctggctttgaacaattacgaacaataatgaaggacaaatgaatcctgaaggaagatttttaaaaatgttttgtttcttcttacaaatggagatttttttgtaccagctttaccacttttcagccatttattaatatgggaatttaacttactcaagcaatagttgaagggaaggtgcatattatcacggatgcaatttatgttgtgtgccagtctggtcccaaacatcaatttcttaacatgagctccagtttacctaaatgttcactgacacaaaggatgagattacacctacagtgactctgagtagtcacatatataagcactgcacatgagatatagatccgtagaattgtcaggagtgcacctctctacttgggaggtacaattgccatatgatttctagctgccatggtggttaggaatgtgatactgcctgtttgcaaagtcacagaccttgcctcagaaggagctgtgagccagtattcatttaagaggcaataaggcaaatgccagaattaaaaaaaaaaatcatcaaagacagaaaatgcctgaccaaattctaaaacctaatccatataagtttattcatttaggaatgttcgtttaaattaatctgcagtttttaccaagagctaagccaatatatgtgcttttcaaccagtattgtcacagcatgaaagtcaagtcaggttccagactgttaagaggtgtaatctaatgaagaaatcaattagatgccccgaaatctacagtcgctgaataaccaataaacagtaacctccatcaaatgctataccaatggaccagtgttagtagctgctccctgtattatgtgaacagtcttattctatgtacacagatgtaattaaaattgtaatcctaacaaacaaaagaaatgtagttcagcttttcaatgtttcatgtttgctgtgcttttctgaattttatgttgcattcaaagactgttgtcttgttcttgtggtgtttggattcttgtggtgtgtgcttttagacacagggtagaattagagacaatattggatgtacaattcctcaggagactacagtagtatattctattccttaccagtaataaggttcttcctaataataattaagagattgaaactccaaacaagtattcattatgaacagatacacatcaaaatcataataatattttcaaaacaaggaataatttctctaatggtttattatagaataccaatgtatagcttagaaataaaactttgaatatttcaagaatatagataagtctaatttttaaatgctgtatatatggctttcactcaatcatctctcagatgttgttattaactcgctctgtgttgttgcaaaactttttggtgcagattcgtttccaaaactattgctactttgtgtgctttaaacaaaataccttgggttgatgaaacatcaacccagtgctaggaatactgtgtatctatcattagctatatgggactatattgtagattgtggtttctcagtagagaagtgactgtagtgtgattctagataaatcatcattagcaattcattcagatggtcaataacttgaaatttatagctgtgataggagttcagaaattggcacatccctttaaaaataacaacagaaaatacaactcctgggaaaaaaggtgctgattctataagattatttatatatgtaagtgtttaaaaagattattttccagaaagtttgtgcagggtttaagttgctactattcaactacactatatataaataaaatatatacaatatatacattgttttcactgtatcacattaaagtacttgggcttcagaagtaagagccaaccaactgaaaacctgagatggagatatgttcaaagaatgagatacaattttttagttttcagtttaagtaactctcagcattacaaaagagtaagtatctcacaaataggaaataaaactaaaacgtggatttaaaaagaactgcacgggctttagggtaaatgctcatcttaaacctcactagagggaagtcttctcaagtttcaagcaagaccatttacttaatgtgaagttttggaaagttataaaggtgtatgttttagccatatgattttaattttaattttgcttcttttaggttcgttcttatttaaagcaatatgattgtgtgactccttgtagttacacttgtgtttcaatcagatcagattgttgtatttattccactattttgcatttaaatgataacataaaagatataaaaaatttaaaactgctatttttcttatagaagagaaaatgggtgttggtgattgtattttaattatttaagcgtctctgtttacctgcctaggaaaacattttatggcagtcttatgtgcaaagatcgtaaaaggacaaaaaatttaaactgcttataataatccaggagttgcattatagccagtagtaaaaataataataataataataaaaccatgtctatagctgtagatgggcttcacatctgtaaagcaatcaattgtatatttttgtgatgtgtaccatactgtgtgctccagcaaatgtccatttgtgtaaatgtatttattttatattgtatatattgttaaatgcaaaaaggagatatgattctgtaactccaatcagttcagatgtgtaactcaaattattatgcctttcaggatgatggtagagcaatattaaacaagcttccacttt

SEQ ID NO: 9862 - DNA, 2206 bp, Homo sapiens
gtgaccggaggcgagaaaccccgcctcggcaccctgacgcagcgcaggacccgccccgcgcgtgacgccagcgtcaggccagccccggcatgctctgcggccgcccgcggtccagctccgacaacaggaattttctccgagagcgggccgggctcagttcagctgctgtccagacccggatcggcaacagtgccgcctccagacgttctcctgccgctcgcccgcccgtcccagcgcccccagccctcccgcgagggcgccccgggacggaaggatccaccagtctgtcggcgcccgccgttctcgtggtcgccgtcgccgtcgtcgtggtggtagtctccgccgtcgcctgggccatggccaattacatccacgtccctcccggctccccggaggtgcccaagctgaacgtcaccgttcaggatcaggaggagcatcgctgccgggagggggccctgagcctcctgcaacacctgcggcctcactgggacccccaggaggtgaccctgcagctcttcacagatggaatcacaaataaacttattggctgttacgtgggaaacaccatggaggatgtagtcctggtgagaatttatggcaataagactgagttattagtcgatcgagatgaggaagtaaagagttttcgagtgttgcaggctcatgggtgtgcaccacaactctactgtaccttcaataatggactatgctatgaatttatacaaggagaagcactggatccaaagcatgtctgcaacccagccattttcaggctaatagctcgtcagcttgctaaaatccatgctattcatgcacacaatggctggatccccaaatctaatctttggctaaagatgggaaagtatttctctctcattcccacaggatttgcagatgaagacattaataaaaggttcctaagtgatatcccaagctctcagattctccaggaagagatgacttggatgaaggagattctttccaacctgggctcacctgttgtgctttgccataatgacctattgtgtaagaatataatctacaatgagaaacaaggtgatgtacagttcattgattatgaatattctggatacaactacctggcatatgatattggaaatcatttcaatgaatttgcaggtgtgagtgatgtagactatagtctgtatccagatagagaactacagagtcagtggctgcgtgcttaccttgaagcctacaaagaatttaagggctttgggactgaagttactgaaaaggaggtagaaatactcttcattcaagtcaatcagtttgcattggcttctcatttcttttggggattgtgggctttgattcaagccaaatactccactattgagtttgatttccttgggtatgcaattgttcgttttaaccagtactttaaaatgaagcctgaggttactgcattaaaagtgcctgagtaaagaagagatttaattattctccagtagctgagcaatgcttgtgaatcttttcttaagaaatcccaaaaagccaatattagttaaaattctgttgtttaatttggttatcttgctttataaattatgcctctaaacaatcaaatctatttttgaaatagactgaatgatgtcaagaaatatacctactgctatccgtatgtggtggattagaaatgtgttaaatctgcaaaaggtataaagatgtcagtttaatttctttgataatttaacctatgttgtatgtgaattatttattataaacttagcacgattctgtgactgtttttctctgtttcacgttcgttgagtgtaagcaatgaaaatgtcccaaataagttttttaagttttactttaataagattaatttcagtaaacattctagttgttcagtgtaacctttttatcttgatgcattgtaagtaaaatgaatcatttactcttgaaatgccagtcattgactgatgtagataatttaggattttcatataaaaatagctgtttaggaaggtgaaatacattcactgtctctgttggtggtacatcttgttgaattcaatattagaaagtatttctttttggggtaatataacttagaattaaatccctgtttctctatgtagtctggcagtataaatataaatatttaccatataatcttggaataagtattagttaatgttaccaaaatctgtattaaataatgttttcaaatgctaaa

SEQ ID NO: 9863 - DNA, 1083 bp, Homo sapiens
gccagcgtcaggccagccccggcatgctctgcggccgcccgcggtccagctccgacaacaggaattttctccgagagcgggccgggctcagttcagctgctgtccagacccggatcggcaacagtgccgcctccagacgttctcctgccgctcgcccgcccgtcccagcgcccccagccctcccgcgagggcgccccgggacggaaggatccaccagtctgtcggcgcccgccgttctcgtggtcgccgtcgccgtcgtcgtggtggtagtctccgccgtcgcctgggccatggccaattacatccacgtccctcccggctccccggaggtgcccaagctgaacgtcaccgttcaggatcaggaggagcatcgctgccgggagggggccctgagcctcctgcaacacctgcggcctcactgggacccccaggaggtgaccctgcagctcttcacagatggaatcacaaataaacttattggctgttacgtgggaaacaccatggaggatgtagtcctggtgagaatttatggcaataagactgagttattagtcgatcgagatgaggaagtaaagagttttcgagtgttgcaggctcatgggtgtgcaccacaactctactgtaccttcaataatggactatgctatgaatttatacaaggagaagcactggatccaaagcatgtctgcaacccagccattttcagtttatcatcgttgactctttgcaaaggaaaaactacaagatgttttggattaaccggctgcagagggtcaaggcttctgcttagttttttctagttagtgtttgagttgaagtgttatacatttcttactgccgattgcttattacttaattgttcatgttttcagagttcttgcctattaaaattttattaatttggttaacaattctttgttctttacgttgttcattatttaatttaatatattatgttttctataaagaataatgtcatatatgcttgatcatttttccaaaattgccagctttaaaaattctctttctgctcttgaaaactctagaaaatggtctggatttgaaaacagcattcataggtta

SEQ ID NO: 9864 - DNA, 2262 bp, Homo sapiens
gtgaccggaggcgagaaaccccgcctcggcaccctgacgcagcgcaggacccgccccgcgcgtgacgccagcgtcaggccagccccggcatgctctgcggccgcccgcggtccagctccgacaacaggaattttctccgagagcgggccgggctcagttcagctgctgtccagacccggatcggcaacagtgccgcctccagacgttctcctgccgctcgcccgcccgtcccagcgcccccagccctcccgcgagggcgccccgggacggaaggatccaccagtctgtcggcgcccgccgttctcgtggtcgccgtcgccgtcgtcgtggtggtagtctccgccgtcgcctgggccatggccaattacatccacgtccctcccggctccccggaggtgcccaagctgaacgtcaccgttcaggatcaggaggagcatcgctgccgggagggggccctgagcctcctgcaacacctgcggcctcactgggacccccaggaggtgaccctgcagctcttcacagatggaatcacaaataaacttattggctgttacgtgggaaacaccatggaggatgtagtcctggtgagaatttatggcaataagactgagttattagtcgatcgagatgaggaagtaaagagttttcgagtgttgcaggctcatgggtgtgcaccacaactctactgtaccttcaataatggactatgctatgaatttatacaaggagaagcactggatccaaagcatgtctgcaacccagccattttcaggctaatagctcgtcagcttgctaaaatccatgctattcatgcacacaatggctggatccccaaatctaatctttggctaaagatgggaaagtatttctctctcattcccacaggatttgcagatgaagacattaataaaaggttcctaagtgatatcccaagctctcagattctccaggaagagatgacttggatgaaggagattctttccaacctgggctcacctgttgtgctttgccataatgacctattgtgtaagaatataatctacaatgagaaacaaggtgatgtacagttcattgattatgaatattctggatacaactacctggcatatgatattggaaatcatttcaatgaatttgcaggtgtgagtgatgtagactatagtctgtatccagatagagaactacagagtcagtggctgcgtgcttaccttgaagcctacaaagaatttaagggctttgggactgaagttactgaaaaggaggtagaaatactcttcattcaagtcaatcagtttgcattgggtgaaaacttgaattttatcattggcaacaaatattgtcagttattttcactgaaatggcttctcatttcttttggggattgtgggctttgattcaagccaaatactccactattgagtttgatttccttgggtatgcaattgttcgttttaaccagtactttaaaatgaagcctgaggttactgcattaaaagtgcctgagtaaagaagagatttaattattctccagtagctgagcaatgcttgtgaatcttttcttaagaaatcccaaaaagccaatattagttaaaattctgttgtttaatttggttatcttgctttataaattatgcctctaaacaatcaaatctatttttgaaatagactgaatgatgtcaagaaatatacctactgctatccgtatgtggtggattagaaatgtgttaaatctgcaaaaggtataaagatgtcagtttaatttctttgataatttaacctatgttgtatgtgaattatttattataaacttagcacgattctgtgactgtttttctctgtttcacgttcgttgagtgtaagcaatgaaaatgtcccaaataagttttttaagttttactttaataagattaatttcagtaaacattctagttgttcagtgtaacctttttatcttgatgcattgtaagtaaaatgaatcatttactcttgaaatgccagtcattgactgatgtagataatttaggattttcatataaaaatagctgtttaggaaggtgaaatacattcactgtctctgttggtggtacatcttgttgaattcaatattagaaagtatttctttttggggtaatataacttagaattaaatccctgtttctctatgtagtctggcagtataaatataaatatttaccatataatcttggaataagtattagttaatgttaccaaaatctgtattaaataatgttttcaaatgct

SEQ ID NO: 9865 - DNA, 1431 bp, Homo sapiens
attctcctctcttctgctgagaccttccttctgcaggacctgtgctcctaagggacttgcaatcatcccatccttggccctctggttaatcgccttagaaatggcaaagattcatactatccacgccaacggcagcctgcccaagcccatcctctggcacaagatgcacaattatttcacgcttgtgaagaacgagatcaaccccagcctttctgcagatgtccctaaggtagaggtgttggaacgggagctggcctggctgaaggagcatctgtcccagctggagtcccctgtggtgttttgtcacaatgacctgctctgcaagaatatcatctatgacagcatcaaaggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtgaccagccaccccatccctcccctacccatctgtctggccagacctgttctccagagctcaattctgcactctgggatccacacccttggacagggtgggagaggggacacatgggtgtccagggagaaggctctgtccctgccgccagaccccagtggttgccactgaagacctcattctcctgtctggaggggctgataggacccccttccgggggtccccttcaccccaccaggcttgggaggaagtgcctgcagccaggtcctgaaccataaccacccctgggaaacacatcattcccagcctcaggccctgctggaattggggctgccttatatgtgtgtttaccccttcctggcctggggaaggaggcggggagggctcctttctacctccagtgccctgagcctccagtccgtctccccctgcatgccccatgtgggaggtgctgagctccaaaccagcatcacaccaactctgacacatggatgtacctatcttggtgatgggtgggggccaagaattgagcatgacatcttccccagcagccacctcctctgagatccctcaccttctccaaaccagatccaatcaaacctcagcccgaggaaacatgctccccaacgtgctctcctgtgcttctgttttgtccccctgctggggggacaggagagggagtggtgaggccctgggcctccagagcct

SEQ ID NO: 9866 - DNA, 2486 bp, Homo sapiens
ggcgtcgcccccaccccgcgctccaggtagcggcggcctcagctgccggcggtggctggctgagctccccagcggcccgcgggccggggcgggggcgggccgggggcgttcccgcgggccaccgcccgtgatgtcacaatcgcggcgggccgcggcgctccggggtcggcggtgggcggcgggccgcgagccggcgatcgaagcgggcagctcgcgcctgagtcatggacttcccctggcccctcctctaccactcccactccctcgccggacccccccgccggggctagcgtctgccgcggctccgagggggtggggctgctgggaatggctgtgcccccttcggcccctcagccgcgcgcgtcctttcacctgaggaggcacacgccttgcccgcagtgctcatggggcatggaggagaaggcggcggccagcgccagctgccgggagccgccgggccccccgagggccgccgccgtcgcgtacttcggcatttccgtggacccggacgacatccttcccggggccctgcgcctcatccaggagctgcggccgcattggaaacccgagcaagttcggaccaagcgcttcacggatggcatcaccaacaagctggtggcctgctatgtggaggaggacatgcaggactgcgtgctggtccgggtgtatggggagcggacggagctgctggtggaccgggagaatgaggtcagaaacttccagctgctgcgagcacacagctgtgcccccaaactctactgcaccttccagaatgggctgtgctatgagtacatgcagggtgtggccctggagcctgagcacatccgtgagccccggcttttcagcctttctgcagatgtccctaaggtagaggtgttggaacgggagctggcctggctgaaggagcatctgtcccagctggagtcccctgtggtgttttgtcacaatgacctgctctgcaagaatatcatctatgacagcatcaaaggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtgaccagccaccccatccctcccctacccatctgtctggccagacctgttctccagagctcaattctgcactctgggatccacacccttggacagggtgggagaggggacacatgggtgtccagggagaaggctctgtccctgccgccagaccccagtggttgccactgaagacctcattctcctgtctggaggggctgataggacccccttccgggggtccccttcaccccaccaggcttgggaggaagtgcctgcagccaggtcctgaaccataaccacccctgggaaacacatcattcccagcctcaggccctgctggaattggggctgccttatatgtgtgtttaccccttcctggcctggggaaggaggcggggagggctcctttctacctccagtgccctgagcctccagtccgtctccccctgcatgccccatgtgggaggtgctgagctccaaaccagcatcacaccaactctgacacatggatgtacctatcttggtgatgggtgggggccaagaattgagcatgacatcttccccagcagccacctcctctgagatccctcaccttctccaaaccagatccaatcaaacctcagcccgaggaaacatgctccccaacgtgctctcctgtgcttctgttttgtccccctgctggggggacaggagagggagtggtgaggccctgggcctccagagcctggctctgctttgtgctgtggcttagccggaggggacgtggccaagggtgaggtggccaaaaccagaaccagcagtctcctgccttgttccctccctggccctcaggccctccttccagggatgtctctccagctctactttatgtcctgaagctgacccgaggtcttcctatctggaatgactagagggagccaagaggatggggtgggggccagggccccccagggcctatcgtgggagagcctgggcaggatcccatcagaaaggtgctgactaaactggttgcccggacactcaacagcctccacctccctttctaccctcacagctcctggggccttcctggctctggcccagaaagtgattcatttgtaaattatcatggttttctttctgcattaaaatgctcatttccgg

SEQ ID NO: 9867 - DNA, 2431 bp, Homo sapiens
gctagcgtctgccgcggctccgagggggtggggctgctgggaatggctgtgcccccttcggcccctcagccgcgcgcgtcctttcacctgaggaggcacacgccttgcccgcagtgctcatggggcatggaggagaaggcggcggccagcgccagctgccgggagccgccgggccccccgagggccgccgccgtcgcgtacttcggcatttccgtggacccggacgacatccttcccggggccctgcgcctcatccaggagctgcggccgcattggaaacccgagcaagttcggaccaagcgcttcacggatggcatcaccaacaagctggtggcctgctatgtggaggaggacatgcaggactgcgtgctggtccgggtgtatggggagcggacggagctgctggtggaccgggagaatgaggtcagaaacttccagctgctgcgagcacacagctgtgcccccaaactctactgcaccttccagaatgggctgtgctatgagtacatgcagggtgtggccctggagcctgagcacatccgtgagccccggcttttcaggttaatcgccttagaaatggcaaagattcatactatccacgccaacggcagcctgcccaagcccatcctctggcacaagatgcacaattatttcacgcttgtgaagaacgagatcaaccccagcctttctgcagatgtccctaaggtagaggtgttggaacgggagctggcctggctgaaggagcatctgtcccagctggagtcccctgtggtgttttgtcacaatgacctgctctgcaagaatatcatctatgacagcatcaaaggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctgggtcctagctgtgtgtcttccacaatgactgcatccctccagtgctgtagagtcggaaacaggcatggggagattgccaggctgaccctctctggtctgtttccaggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtgaccagccaccccatccctcccctacccatctgtctggccagacctgttctccagagctcaattctgcactctgggatccacacccttggacagggtgggagaggggacacatgggtgtccagggagaaggctctgtccctgccgccagaccccagtggttgccactgaagacctcattctcctgtctggaggggctgataggacccccttccgggggtccccttcaccccaccaggcttgggaggaagtgcctgcagccaggtcctgaaccataaccacccctgggaaacacatcattcccagcctcaggccctgctggaattggggctgccttatatgtgtgtttaccccttcctggcctggggaaggaggcggggagggctcctttctacctccagtgccctgagcctccagtccgtctccccctgcatgccccatgtgggaggtgctgagctccaaaccagcatcacaccaactctgacacatggatgtacctatcttggtgatgggtgggggccaagaattgagcatgacatcttccccagcagccacctcctctgagatccctcaccttctccaaaccagatccaatcaaacctcagcccgaggaaacatgctccccaacgtgctctcctgtgcttctgttttgtccccctgctggggggacaggagagggagtggtgaggccctgggcctccagagcctggctctgctttgtgctgtggcttagccggaggggacgtggccaagggtgaggtggccaaaaccagaaccagcagtctcctgccttgttccctccctggccctcaggccctccttccagggatgtctctccagctctactttatgtcctgaagctgacccgaggtcttcctatctggaatgactagagggagccaagaggatggggtgggggccagggccccccagggcctatcgtgggagagcctgggcaggatcccatcagaaaggtgctgactaaactggttgcccggacactcaacagcctccacctccctttctaccctcacagctcctggggccttcctggctctggcccagaaagtgattcatttgtaaattatcatggttttctttctgcattaaaatgctcatttccgga

SEQ ID NO: 9868 - DNA, 2434 bp, Homo sapiens
cggcgggccgcgagccggcgatcgaagcgggcagctcgcgcctgagtcatggacttcccctggcccctcctctaccactcccactccctcgccggacccccccgccggggctagcgtctgccgcggctccgagggggtggggctgctgggaatggctgtgcccccttcggcccctcagccgcgcgcgtcctttcacctgaggaggcacacgccttgcccgcagtgctcatggggcatggaggagaaggcggcggccagcgccagctgccgggagccgccgggccccccgagggccgccgccgtcgcgtacttcggcatttccgtggacccggacgacatccttcccggggccctgcgcctcatccaggagctgcggccgcattggaaacccgagcaagttcggaccaagcgcttcacggatggcatcaccaacaagctggtggcctgctatgtggaggaggacatgcaggactgcgtgctggtccgggtgtatggggagcggacggagctgctggtggaccgggagaatgaggtcagaaacttccagctgctgcgagcacacagctgtgcccccaaactctactgcaccttccagaatgggctgtgctatgagtacatgcagggtgtggccctggagcctgagcacatccgtgagccccggcttttcaggttaatcgccttagaaatggcaaagattcatactatccacgccaacggcagcctgcccaagcccatcctctggcacaagatgcacaattatttcacgcttgtgaagaacgagatcaaccccagcctttctgcagatgtccctaaggtagaggtgttggaacgggagctggcctggctgaaggagcatctgtcccagctggagtcccctgtggtgttttgtcacaatgacctgctctgcaagaatatcatctatgacagcatcaaaggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtgaccagccaccccatccctcccctacccatctgtctggccagacctgttctccagagctcaattctgcactctgggatccacacccttggacagggtgggagaggggacacatgggtgtccagggagaaggctctgtccctgccgccagaccccagtggttgccactgaagacctcattctcctgtctggaggggctgataggacccccttccgggggtccccttcaccccaccaggcttgggaggaagtgcctgcagccaggtcctgaaccataaccacccctgggaaacacatcattcccagcctcaggccctgctggaattggggctgccttatatgtgtgtttaccccttcctggcctggggaaggaggcggggagggctcctttctacctccagtgccctgagcctccagtccgtctccccctgcatgccccatgtgggaggtgctgagctccaaaccagcatcacaccaactctgacacatggatgtacctatcttggtgatgggtgggggccaagaattgagcatgacatcttccccagcagccacctcctctgagatccctcaccttctccaaaccagatccaatcaaacctcagcccgaggaaacatgctccccaacgtgctctcctgtgcttctgttttgtccccctgctggggggacaggagagggagtggtgaggccctgggcctccagagcctggctctgctttgtgctgtggcttagccggaggggacgtggccaagggtgaggtggccaaaaccagaaccagcagtctcctgccttgttccctccctggccctcaggccctccttccagggatgtctctccagctctactttatgtcctgaagctgacccgaggtcttcctatctggaatgactagagggagccaagaggatggggtgggggccagggccccccagggcctatcgtgggagagcctgggcaggatcccatcagaaaggtgctgactaaactggttgcccggacactcaacagcctccacctccctttctaccctcacagctcctggggccttcctggctctggcccagaaagtgattcatttgtaaattatcatggttttctttctgcattaaaatgctcatttccgga

SEQ ID NO: 9869 - DNA, 1880 bp, Homo sapiens
agacggttggggggtgggacagcggaagggaagactggaagaggactgggagggcccagctgggacacagggcctcgggcgatggggtctttatcaaggccctccttctctgaccggttaatcgccttagaaatggcaaagattcatactatccacgccaacggcagcctgcccaagcccatcctctggcacaagatgcacaattatttcacgcttgtgaagaacgagatcaaccccagcctttctgcagatgtccctaaggtagaggtgttggaacgggagctggcctggctgaaggagcatctgtcccagctggagtcccctgtggtgttttgtcacaatgacctgctctgcaagaatatcatctatgacagcatcaaaggtcacgtgcggttcattgactatgaatatgctggctacaactaccaagcttttgacattggcaaccatttcaatgagtttgcaggcgtgaatgaggtggattactgcctgtacccggcgcgggagacccagctgcagtggctgcactactacctgcaggcacaaaaggggatggccgtgacccccagggaggtgcaaaggctctacgtgcaagtcaacaagtttgccctggcgtctcacttcttctgggctctctgggccctcatccagaaccagtactccaccatcgactttgatttcctcaggtacgcagtgatccgattcaaccagtacttcaaggtgaagcctcaagcgtcagccttggagatgccaaagtgaccagccaccccatccctcccctacccatctgtctggccagacctgttctccagagctcaattctgcactctgggatccacacccttggacagggtgggagaggggacacatgggtgtccagggagaaggctctgtccctgccgccagaccccagtggttgccactgaagacctcattctcctgtctggaggggctgataggacccccttccgggggtccccttcaccccaccaggcttgggaggaagtgcctgcagccaggtcctgaaccataaccacccctgggaaacacatcattcccagcctcaggccctgctggaattggggctgccttatatgtgtgtttaccccttcctggcctggggaaggaggcggggagggctcctttctacctccagtgccctgagcctccagtccgtctccccctgcatgccccatgtgggaggtgctgagctccaaaccagcatcacaccaactctgacacatggatgtacctatcttggtgatgggtgggggccaagaattgagcatgacatcttccccagcagccacctcctctgagatccctcaccttctccaaaccagatccaatcaaacctcagcccgaggaaacatgctccccaacgtgctctcctgtgcttctgttttgtccccctgctggggggacaggagagggagtggtgaggccctgggcctccagagcctggctctgctttgtgctgtggcttagccggaggggacgtggccaagggtgaggtggccaaaaccagaaccagcagtctcctgccttgttccctccctggccctcaggccctccttccagggatgtctctccagctctactttatgtcctgaagctgacccgaggtcttcctatctggaatgactagagggagccaagaggatggggtgggggccagggccccccagggcctatcgtgggagagcctgggcaggatcccatcagaaaggtgctgactaaactggttgcccggacactcaacagcctccacctccctttctaccctcacagctcctggggccttcctggctctggcccagaaagtgattcatttgtaaattatcatggttttctttctgcattaaaatgctcatttccgg

SEQ ID NO: 9870 - DNA, 962 bp, Homo sapiens
agtgccgtagcgcccggctcctgcaggcgctcggcctccgctcattcctgaccccgcagtgggcgcgatggcggaggctgtactgagggtcgcccggcggcagctgagccagcgcggcgggtctggagcccccatcctcctgcggcagatgttcgagcctgtgagctgcaccttcacgtacctgctgggtgacagagagtcccgggaggccgttctgatcgacccagtcctggaaacagcgcctcgggatgcccagctgatcaaggagctggggctgcggctgctctatgctgtgaatacccactgccacgcggaccacattacaggctcggggctgctccgttccctcctccctggctgccagtctgtcatctcccgccttagtggggcccaggctgacttacacattgaggatggagactccatccgcttcgggcgcttcgcgttggagaccagggccagccctggccacaccccaggctgtgtcaccttcgtcctgaatgaccacagcatggccttcactggagatgccctgttgatccgtgggtgtgggcggacagacttccagcaaggctgtgccaagaccttgtaccactcggtccatgaaaagatcttcacacttccaggagactgtctgatctaccctgctcacgattaccatgggttcacagtgtccaccgtggaggaggagaggactctgaaccctcggctcaccctcagctgtgaggagtttgtcaaaatcatgggcaacctgaacttgcctaaacctcagcagatagactttgctgttccagccaacatgcgctgtggggtgcagacacccactgcctgatctcacttctgtcagatgctcccatccactattaatgcactaggtgggaggagagggcggcaatgacactgcacctctcctttcccaccgcattccctggagctccctaaataaaactttttttaacgtg

SEQ ID NO: 9871 - DNA, 2258 bp, Homo sapiens
ccccgcctcgtggtgccggctggttcttcgcgctcgcccgacttcccagcggccccgtgcggcccgggcatgcccagtgcgggcgcagcggccccggccctggaagcgccccggcggagctggcctgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaaggaattgaaatgcaccagcggttgtctaacatagaaaggaattggccttactactttgggtttggtttgcccttggcttttctcacagcaatgcagtcctcatatattatcagtggctgccttttctctatcctctttcctttattcattatcagcgccaatgaagcaaagcctggcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttccc

SEQ ID NO: 9872 - DNA, 2146 bp, Homo sapiens
ccccgcctcgtggtgccggctggttcttcgcgctcgcccgacttcccagcggccccgtgcggcccgggcatgcccagtgcgggcgcagcggccccggccctggaagcgccccggcggagctggcctgcggtgggctaggggcagggccggagccgcggcggcggagctgtggatccttcatgatgagagatttggggacacttctctctcctgtgtgtagttgatagtttggtggtgaagagatggctgacagtgtcaaaacctttctccaggaccttgccagaggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagagtgagccacgtattgttagtagaattttccagtgttgtgcttggaatggtggagtgttctggttcagtctcctcttgttttatcgagtatttattcctgtgcttcagtcggtaacagcccgaattatcggtgacccatcactacatggagatgtttggtcgtggctggaattcttcctcacgtcaattttcagtgctctttgggtgctccccttgtttgtgcttagcaaagtggtgaatgccatttggtttcaggatatagctgacctggcatttgaggtatcagggaggaagcctcacccattccctagtgtcagcaaaataattgctgacatgctcttcaaccttttgctgcaggctcttttcctcattcagggaatgtttgtgagtctctttcccatccatcttgtcggtcagctggttagtctcctgcatatgtcccttctctactcactgtactgctttgaatatcgttggttcaataaagtggctgccttttctctatcctctttcctttattcattatcagcgccaatgaagcaaagacccgcaaagcatatctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttccc

SEQ ID NO: 9873 - DNA, 3150 bp, Homo sapiens
acttgataacacccgtggtgccccatccctataggagctggtgagattgcagcctgctgcctcccctccaacagccacagctattggatttcccacccagaatctttaggtaaatgagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtagatttgttggacagcaaaactttctgccgggctcagatctccatgacaaccaccagtcaccttcctgttgcagagtcacctgatatgaaaaaggagcaagacccccctgccaagtgccacaccaaaaagcacaacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacggtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagtaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtcaccaaggagttaaaagcttcttcttcaatagaggaattgttctgggggtcctggagacttaccattgagccatgcaatctgggaagcacaggaataagtagacactttgaaaatggatttgaatgttctcatcccttttgcagcttttctttttggctctctcatgtccttggcttgctcctctattctacctctctttctccagcaataatatgcaaatgaagacatgtatccataagaaggagtgctcttcatcaactaatagagcacctaccacagtgtcatacctggtagaggtgagcaattcatattcaaaggttgcaaagtgtttgtaatatattcatgaggctggaagtaagaagaattaaaaatttgtcctaattacaatgagaaccattctaggtagtgatcttggagcacacatgaataactttctgaaggtgcaaccaaatccatttttatttctgcctggcttggtcacttctgtaaaggtttaacttagtgttgtcaagtaacagttactgaaagagctgagaaaa

SEQ ID NO: 9874 - DNA, 1280 bp, Homo sapiens
ctcagcagcaacaaatgccttctgagacagggattcttttgattttgcttggacattgtggagaagtgttagccccaatgtggactgatctgggaacagtgggaaattaacttcttgttggtaaatatcaggctgagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtagatttgttggacagcaaaactttctgccgggctcagatctccatgacaaccaccagtcaccttcctgttgcagagtcacctgatatgaaaaaggagcaagacccccctgccaagtgccacaccaaaaagcacaacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacggtcgattaaaaaaattattttgttacttcgaagtatgtcctatatggggaaaaaacgtacacagttttctgtgaaatatga

SEQ ID NO: 9875 - DNA, 1481 bp, Homo sapiens
aacccactgctttattctgccctgagtggagattggttttggctcaggctgctttgtgaaactcagaagcattatcctctctgccaactccacgtcctagtcagagttttctgtgaaggcaagggcatggggttgccggagagaagaggattggtcctgcttttaagcctagctgaaattcttttcaagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtagatttgttggacagcaaaactttctgccgggctcagatctccatgacaaccaccagtcaccttcctgttgcagagtcacctgatatgaaaaaggagcaagacccccctgccaagtgccacaccaaaaagcacaacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacggtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttag

SEQ ID NO: 9876 - DNA, 1501 bp, Homo sapiens
attttcaccgtccatctttgctgatttaccatgctcccaggatggtgggagtgtgtgtttttaagatggagagtgtatgcttctgggttcaagttcacaggtgtctctgctggttatctgcactcaccttggtaacagggagaaagtgagtgaatggattccaagaacttactgatggaagtctaattcaggagttggttctgcagccatggagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtagatttgttggacagcaaaactttctgccgggctcagatctccatgacaaccaccagtcaccttcctgttgcagagtcacctgatatgaaaaaggagcaagacccccctgccaagtgccacaccaaaaagcacaacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacggtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatga

SEQ ID NO: 9877 - DNA, 2519 bp, Homo sapiens
atccctataggagctggtgagattgcagcctgctgcctcccctccaacagccacagctattggatttcccacccagaatctttaggtaaatgagatcatgattctggaaggaggtggtgtaatgaatctcaaccccggcaacaacctccttcaccagccgccagcctggacagacagctactccacgtgcaatgtttccagtgggttttttggaggccagtggcatgaaattcatcctcagtactggaccaagtaccaggtgtgggagtggctccagcacctcctggacaccaaccagctggatgccaattgtatccctttccaagagttcgacatcaacggcgagcacctctgcagcatgagtttgcaggagttcacccgggcggcagggacggcggggcagctcctctacagcaacttgcagcatctgaagtggaacggccagtgcagtagtgacctgttccagtccacacacaatgtcattgtcaagactgaacaaactgagccttccatcatgaacacctggaaagacgagaactatttatatgacaccaactatggtagcacagtagcagagtcacctgatatgaaaaaggagcaagacccccctgccaagtgccacaccaaaaagcacaacccgagagggactcacttatgggaattcatccgcgacatcctcttgaacccagacaagaacccaggattaataaaatgggaagaccgatctgagggcgtcttcaggttcttgaaatcagaggcagtggctcagctatggggtaaaaagaagaacaacagcagcatgacctatgaaaagctcagccgagctatgagatattactacaaaagagaaattctggagcgtgtggatggacgaagactggtatataaatttgggaagaatgcccgaggatggagagaaaatgaaaactgaagctgccaatactttggacacaaaccaaaacacacaccaaataatcagaaacaaagaactcctggacgtaaatatttcaaagactacttttctctgatatttatgtaccatgaggggaacaagaaactacttctaacgggaagaagaaacactacggtcgattaaaaaaattattttgttacttcgaagtatgtcctatatggggaaaaaacgtacacagttttctgtgaaatatgatgctgtatgtggttgtgattttttttcacctctattgtgaattctttttcactgcaagagtaacaggatttgtagccttgtgcttcttgctaagagaaagaaaaacaaaatcagagggcattaaatgttttgtatgtgacatgatttagaaaaaggtgatgcatcctcctcacataagcatccatatggcttcgtcaagggaggtgaacattgttgctgagttaaattccagggtctcagatggttaggacaaagtggatggatgccgggaagtttaacctgagccttaggatccaatgagtggagaatggggacttccaaaacccaaggttggctataatctctgcataaccacatgacttggaatgcttaaatcagcaagaagaataatggtggggtctttatactcattcaggaatggtttatctgatgccagggctgtcttcctttctcccctttggatggttggtgaaatactttaattgccctgtctgctcacttctagctatttaagagagaacccagcttggttcttttttgctccaagtgcttaaaaataagttggaaaaaggagacggtggtgtggaaatggctgaagagtttgctcttgtatccctatagtccaaggtttctcaatctgcacaattgacatttttggccggagtgttctttgtggtgagggctttcctgtgcattgtaagatgttcagcagtatccactcatggtctctaaccacttgacaccagaaaccccccagctgtgataacgcaaaatgtctctagacatcaccaaatgttccctgggggtggcaaatttgcccttgattgagaaccaccagtttagctagtcaatatgaggatggtggtttattctcagaagaaaaagatatgtaaggtcttttagctccttagagtgaagcaaaagcaagacttcaacctcaacctatctttatgttttaaatgttagggacaataagttgaaatagctagaggagcttcttttcagaaccccagatgagagccaatgtcagataaagtaagcatagtaatgtagcaggaactacaatagaagacattttcactggaattacaaagcagaattaaaattatattgtagaaggaaacaccaagaaaagaatttccagggaaaatcctctttgcaggtattaattcttataattttttgtcttttggattatctgtttactgtctcatctgaactgatcccaggtgaacggtttattgcctagatttgtactcagaggaattttttttgttttgttttgtcttttaagaaaggaaagaaaggatgaaaaaaataaacagaaaactcagctcaggcacaattgtca

SEQ ID NO: 9878 - DNA, 941 bp, Homo sapiens
cagaggaacccgccagagaacattcagaaggccttcatcgcatccatggacctgtggaactgggatgaggcatccccacaggaagtgcctccagggaacaagctggcagggcttgaaggagccaaattaggcttctgtttccctgatctggcactccaaggggacacgccgacagcgacagcagagacatgctggaaaggtacaagctcatccctggcaagcttcccacagctggactggggctccgcgttactgcacccagaagttccatggggggcggagcccgactctcaggctcttccgtggtccggggactggacagacatggcgtgcacagcctgggactcttggagcggcgcctcgcagaccctgggccccgcccctctcggcccgggccccatccccgccgccggctccgaaggcgccgcgggccagaactgctccccgcccgcgcccggactgtaccacctcctggaacccggggctgcatgcgggtggcaccacctctttgaagcggtaccagagctcagctctcaccgtttgctccgaaccgagcccgcagtcggaccgtgccagtttggctcgatgccccaaaactaaccaccgaggtcccattcagctgtggcagttcctcctggagctgctccacgacggggcgcgtagcagctgcatccgttggactggcaacagccgcgagttccagctgtgcgaccccaaagaggtggctcggctgtggggcgagcgcaagagaaagccgggcatgaattacgagaagctgagccggggccttcgctactactatcgccgcgacatcgtgcgcaagagcggggggcgaaagtacacgtaccgcttcgggggccgcgtgcccagcctagcctatccggactgtgcgggaggcggacggggagcagagacacaataaaaattcccggtcaaacctc

SEQ ID NO: 9879 - DNA, 532 bp, Homo sapiens
cagaggaacccgccagagaacattcagaaggccttcatcgcatccatggacctgtggaactgggatgaggcatccccacaggaagtgcctccagggaacaagctggcagggcttgaaggagccaaattaggcttctgtttccctgatctggcactccaaggggacacgccgacagcgacagcagagacatgctggaaaggtcccattcagctgtggcagttcctcctggagctgctccacgacggggcgcgtagcagctgcatccgttggactggcaacagccgcgagttccagctgtgcgaccccaaagaggtggctcggctgtggggcgagcgcaagagaaagccgggcatgaattacgagaagctgagccggggccttcgctactactatcgccgcgacatcgtgcgcaagagcggggggcgaaagtacacgtaccgcttcgggggccgcgtgcccagcctagcctatccggactgtgcgggaggcggacggggagcagagacacaataaaaattcccggtcaaacctc

SEQ ID NO: 9880 - DNA, 1487 bp, Homo sapiens
gcagataagcccagcttagcccagctgaccccagaccctctcccctcactccccccatgtcgcaggatcgagaccctgaggcagacagcccgttcaccaagccccccgccccgcccccatcaccccgtaaacttctcccagcctccgccctgccctcacccagcccgctgttccccaagcctcgctccaagcccacgccacccctgcagcagggcagccccagaggccagcacctatccccgaggctggggtcgaggctcggccccgcccctgcctctgcaacttgagcctggctgcgacccctgctctgacgtctcggaaaattcccccttgcccaggcccttgggggagggggtgcatggtatgaaatggggctgagacccccggctgggggcagaggaacccgccagagaacattcagaaggccttcatcgcatccatggacctgtggaactgggatgaggcatccccacaggaagtgcctccagggaacaagctggcagggcttgaaggagccaaattaggcttctgtttccctgatctggcactccaaggggacacgccgacagcgacagcagagacatgctggaaaggtacaagctcatccctggcaagcttcccacagctggactggggctccgcgttactgcacccagaagttccatggggggcggagcccgactctcaggctcttccgtggtccggggactggacagacatggcgtgcacagcctgggactcttggagcggcgcctcgcagaccctgggccccgcccctctcggcccgggccccatccccgccgccggctccgaaggcgccgcgggccagaactgcgtccccgtggcgggagaggccacctcgtggtcgcgcgcccaggccgccgggagcaacaccagctgggactgttctgtggggcccgacggcgatacctactggggcagtggcctgggcggggagccgcgcacggactgtaccatttcgtggggcgggcccgcgggcccggactgtaccacctcctggaacccggggctgcatgcgggtggcaccacctctttgaagcggtaccagagctcagctctcaccgtttgctccgaaccgagcccgcagtcggaccgtgccagtttggctcgatgccccaaaactaaccaccgaggtcccattcagctgtggcagttcctcctggagctgctccacgacggggcgcgtagcagctgcatccgttggactggcaacagccgcgagttccagctgtgcgaccccaaagaggtggctcggctgtggggcgagcgcaagagaaagccgggcatgaattacgagaagctgagccggggccttcgctactactatcgccgcgacatcgtgcgcaagagcggggggcgaaagtacacgtaccgcttcgggggccgcgtgcccagcctagcctatccggactgtgcgggaggcggacggggagcagagacacaataaaaattcccggtcaaacctc

SEQ ID NO: 9881 - DNA, 1335 bp, Homo sapiens
aggtgagcgatgaactgaggactagatgcctgggtgtctgggttaggaaggacctgggggactagactcccaagaagccgggggcctggactcctgggtctaacagaggaagagagctggggtccctcactcccaggaccaagattttaggctcctggggaaggagggagcggaggcctggactcctggctctgagggaagctagggctggggcccagactccagggcctccaagtgtcaccagctcacccattgccatctggacttttcccgacccagaacattcagaaggccttcatcgcatccatggacctgtggaactgggatgaggcatccccacaggaagtgcctccagggaacaagctggcagggcttgaaggagccaaattaggcttctgtttccctgatctggcactccaaggggacacgccgacagcgacagcagagacatgctggaaaggtacaagctcatccctggcaagcttcccacagctggactggggctccgcgttactgcacccagaagttccatggggggcggagcccgactctcaggctcttccgtggtccggggactggacagacatggcgtgcacagcctgggactcttggagcggcgcctcgcagaccctgggccccgcccctctcggcccgggccccatccccgccgccggctccgaaggcgccgcgggccagaactgcgtccccgtggcgggagaggccacctcgtggtcgcgcgcccaggccgccgggagcaacaccagctgggactgttctgtggggcccgacggcgatacctactggggcagtggcctgggcggggagccgcgcacggactgtaccatttcgtggggcgggcccgcgggcccggactgtaccacctcctggaacccggggctgcatgcgggtggcaccacctctttgaagcggtaccagagctcagctctcaccgtttgctccgaaccgagcccgcagtcggaccgtgccagtttggctcgatgccccaaaactaaccaccgaggtcccattcagctgtggcagttcctcctggagctgctccacgacggggcgcgtagcagctgcatccgttggactggcaacagccgcgagttccagctgtgcgaccccaaagaggtggctcggctgtggggcgagcgcaagagaaagccgggcatgaattacgagaagctgagccggggccttcgctactactatcgccgcgacatcgtgcgcaagagcggggggcgaaagtacacgtaccgcttcgggggccgcgtgcccagcctagcctatccggactgtgcgggaggcggacggggagcagagacacaataa

SEQ ID NO: 9882 - DNA, 1539 bp, Homo sapiens
gggaaccggcgggagggcgcctcctcctcccccgccctctctgctgaggatggaagtgacgaaagcagccgaggaggtcacttcctgctggggtggatgaggaggagccggagacgccgcggaggagaccggaccgaagacggaccgtgccgggaagagcaggcgggtgaaaatgaaagccggctgtagcatcgtggaaaagccagaaggaggtggagggtatcagtttcctgactgggcctacaaaacagagtcatccccaggctcccggcagatccagctgtggcacttcatcctggagctgctgcagaaggaagagttccgccatgtcatcgcctggcagcagggagagtacggggaatttgtcatcaaggatccagatgaggtggcccgcctctggggccgcaggaaatgcaaaccacagatgaattatgacaagctgagccgggccctcagatactattacaacaagaggatccttcataaaacaaaagggaaaagatttacctataaatttaacttcaacaagctggtgatgcccaactacccattcatcaacattcggtcaagtggtaagatacaaactcttttggtagggaattaattttgaattgaaaagaatttttaaaaatccaaatctaagacatggcatgtttaggaagattttagaaacactaaaataatgtgatcctttggattgcctcaatgttcttactcaagtcatctcacttataaggagagttataggctattcagtatcaagatagatttctttggtttatttggttggttcccttttctgcatattgtttgtaatctcctagatactattacgctatcttgtttgggaatgatgtttcataggtttgtgatgatctttacgttcaggactcagttttaacacccagcccagtggttctttcatagatgggaacctgtttctacaaacacttccgattttctgtgaaactaccaagctctcccttatcaagtgaatatcatcaaaaccacagcatccttgatcagagaagggggaggttcacatgtttgcagtgaaaagcagtgtctttgatctgcaacagcaaatcctcagagaaaaagattctggggttacttgaccttctctcctgttaagtgcagtagggcttcccctcttgactttcctggttatagctttccatcacagctccccacattctctcttgatgttgaaagcagtctctcaaaagactttgttgttgtgtggttttttgtttgtgatttttttccttatgcaaatcatactcctgcccaagaaaatacagtagttccccttatctgagcagtatatgttctaagacccctagtagattcgcaaaccacagatagtaccaaactccattcatatatatgatgttttttcttcccttaaccccactcatatgtatctgtgataacgtttaatttataaattaggcacagtaagagattaatgacaataataaaatagaaaaattataacaatatgctgtaataaacttaatgtggtctttctcaaaa

SEQ ID NO: 9883 - DNA, 5254 bp, Homo sapiens
ccggagacgccgcggaggagaccggaccgaagacggaccgtgccgggaagagcaggcgggtgaaaatgaaagccggctgtagcatcgtggaaaagccagaaggaggtggagggtatcagtttcctgactgggcctacaaaacagagtcatccccaggctcccggcagatccagctgtggcacttcatcctggagctgctgcagaaggaagagttccgccatgtcatcgcctggcagcagggagagtacggggaatttgtcatcaaggatccagatgaggtggcccgcctctggggccgcaggaaatgcaaaccacagatgaattatgacaagctgagccgggccctcagatactattacaacaagaggatccttcataaaacaaaagggaaaagatttacctataaatttaacttcaacaagctggtgatgcccaactacccattcatcaacattcggtcaagtggtgtggttcctcagagtgcaccaccagtgccaacagcctcttcccggttccatttcccacctctggacacccattctccaaccaatgatgtgcagccgggacggttctctgctagctccctaactgcttctggccaggagtccagtaatggtactgatagaaagactgagctttcagagctggaggatggctcagctgctgactggcgccggggtgtggatcccgtgtcctccaggaatgccattggtggaggagggattggccatcagaaacgcaagcctgacataatgcttcctctgtttgctaggccagggatgtaccctgacccccacagtcccttcgctgtctctccaatccctggccgcggaggtgtccttaatgtccccatttcaccagccctctccctgactcccaccatcttctcctatagcccatcaccaggcctgagccctttcaccagcagcagctgcttctccttcaaccctgaggaaatgaaacactaccttcattctcaagcttgttctgtgttcaactaccatctgagtcctcggacttttccccgttacccagggctcatggttccaccactgcagtgccaaatgcatcctgaggagtcaactcagttctccatcaagctgcagcccccaccagttgggcggaagaaccgggagagggttgagagcagcgaggagtcagcaccagtcaccacgcccaccatggcttctattcccccaagaatcaaggtggaacctgcctctgaaaaggatcctgagagcctcaggcagtcggcacgagagaaggaggagcacactcaagaagagggcactgtgccaagcaggaccattgaagaggaaaaaggcaccatctttgcccgtcctgctgcaccacccatctggccctctgtgcccattagcaccccaagtggagaacctctggaggtgactgaagacagtgaggataggcctggcaaagagcccagtgcacctgagaagaaagaagatgcactgatgccccccaagcttcggttgaagcggcgctggaatgatgaccctgaagcccgagagctgagcaagagtggcaagtttctctggaatgggtcaggaccccagggcttggcaacagcagctgctgatgcttagaactggaagtggattaggagctgtttatactataatcaaatacatacatgtatttatgtagcaagatttcagggtgggggggagggagttaaactggtttgatcattctaggggcatagacttgtatttttatgttttggggatgggatggggttatcttctgttgtaaattaggtgggatatgaacacacttattttcctggtgagtaggacacagggagggtattgaactcaaaggagaaggagcctctatttcctgttgaggcttatactttctgacaaggaaactcccaaagggccaagatactttttggtcccatgatagtcaggttccagacttctttcttttctattgtatttgtatgtggaaagccattaatgaatttattttactccaagagatacacataaaagggaaaagggcatggttgggaggttgagcagtaagagaccattaatactaagtattttgcctgaaatgcttctttataattatttcagggaaggaataagataatctcagacttactggggtggggcttggggaatgtttggatgttgctctttttcttcttccttcttttttttttttttttttttttggttggtgttgtttggcatttttttcttttcctttttaaagaaaatgttttcaggaaacatgaacaaacatactgccaattatagtggggctgggaaggcacaggagctggcgacctctcagctgcatagttgggacggcaaaccctgctgtgagcttctcagacttttcacctacttcacctattaagaagccatgaggagttgtaaactcttgttcagggaagaaaagagggcaggaggaagtaacccaatgcctttaaatacaaaacagatgaaaaacaaaatactcatttttccttttctattgtgggtttggggagccaaaccaagtgtgactgtgagcacgttcactgagaggcatgacaacattattgaagaggtctttccattatgtctggttctcttattttcttaagtcaagccttaactatgaacatactttaagatgatacgggtctgtcaccataaacctgtaaaagggcatcgacagcttttcagataatccaggaatgttgagacatggctaagtttctagctgatacttagtcattccctcttgatattgttgggatgggtagccaaaaggcaggcttgtgggagttaagagccaatgatacctggaaacatgggaggtagctgggggtacaagtggatgttgagactgaaggaagaggtggaaagaagacacagaaggcacccagatgccaaaaggcctggcatgaatgagagttggcatctgtcctgttgtggtgttcccattcttgccatacccatttgcccagattgttctgattctcatgttcaattgactatcccacatgagactacagtttataggcagtgaggaattgtttcttcctgggaaatgtccttccagcaacttcagaggaatgggaaagtgttaatcttacgtgaagcaaaggagcctggactaggggcagagagaaagaagcagcagcccaccttctttgtgtttgcacatgtgcctatgtcgtgtacattggtacctgactgtggctcagatctgcgtcgcagcagcgagagaagaaatcactccatatccgatgagaggaagggtggcacagagatggtgtctacaattagagacatttctgactccaccttagcctaagcaaactttatatactgagtaacatttgaaggttgtcttttaatggtggggggtgttttttcctttttaaactacagtgcttgcacaagagagggagggactcagaaaaggttagggcaggtgagggagacagtagatggcctgggatgacttgagtccatcatactattgcttggcaggtgtcctcccccatgtttgattcaaattccatgagtgacctacctttccccaggaatgggactgagagggtagtctccagcaactcagtctgcacagggctccccgttcaggctgcctttggtggttgtgcttttgtaagtttctttctctgcacttcgacttacctctgaatcagaaagcaagcccagcaggtgaatgagggatgtctgcttggcattgcccaatctaaccagggaggctggctggccacccactgtccgctagaggggagagctagcaggtgttggtatgaactcaggaatagaaacacgaggcctttttaaatacgagggagaagaatccatgatgcatacctgtaaccccctagaacccaagtgccagaattcctagatgctgcttctgtttgaacaaaatgtcactgcttttacacttgaaaaaaacacactcgaaaaatgttcaactccatgaaaaatattttttggctttaagaaattgtttggtgtttaactgtttcctttgattgccattccaccagtaaattgttggttgatttgcactgcactctggggttggggttgggaggggagggtccttatacagagccgaacctggggttgctcaggaagtgggccagggaatgtggaagtcgttgacattgcctgggccaaaagagtgggagatagtttttctcccctcagcccactcctggtagcacctgtcgccagcctggtacaaagccaggcctttttcttctgtgagcatctcatcactgtccagcagcaggtggaaaaagggggacaacaaccagacctattttttctcccccattttttccaaattttgctgtgccaaatgtttaaaattttataaatatgaatctattgaaatttccttaatcaagagcttcttcgtgtaaagtttgcttttttagctatagaaaaagaaaacagtaaatatctcttaatggcatccagccttgctgagctcaccttttttcctgaagaatgggtaggagtgaaatatttaatgtaaacatttcaccaagtccctttaccctaattttgaagctgcattaaacccaactcactaacacagggaatgattgcaccctagtcctctgtgggccaagaaactttcagaagcattaaaaaaatagttgaagtatatcacttctcaccaagtgggtagagtcagttggctgtttgtcccttgttttttatttattccataattatgtttgtgctttttgttttgtaaacagtaatggaacgtacatttttattttgtttagaagacaactttgattcaatctttcaagaactgttccattcttggtttcttcttagggggataaaaagttaccagttaatttgttttgagatatttaagcattctttgagttatagaattgtgatgcagggatttgtgaatgagacatttacatgtgaaaggtgacttcactagttacctgcttgagcagagtaaagtgtgtatatgtacataaaatgtaagtaatcttaactccattgtgcagtgccttttagatgttccgctttctataaagtcttcaaatttttgcatatatattatatatatatgatgtaatgttatagaaatatatgtataatatacatattttttccaggggtatctgatagctctgtattttgttatggaagttgaaagaaaaaagtattttacctcagaaattaaataaaaaaatacttttaagtaa

SEQ ID NO: 9884 - DNA, 4111 bp, Homo sapiens
agcctggttggcagctgcggcgcagagtccagccgctggtgcgcggagcggttcaccgtcttcggagcggttcggcccagcctttcgcccaggcgcccaggcccgctgcgcgcgtgcgtgagcgcgcctgcgccgccggggccgctgcaaggggaggagagaggccgcctcaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatagtatgtgacaatctgcatcgatcatggactactaaatgcctttacatagaagggctctgatttgcacaatttgttgaaaaatcacaaacccatagaaaagtaagtaggctaagttggggaggctcaaaccattaagggttaaaaatacatcttaaacattggaaagctcttctagctgaatctgaaatattaccccttgtctagaaaaaggggggcagtcagaacagctgttccccactccgtggttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagcaaaaaaacgaaaaacaaaaaacaaaaacaaaccttttggtaactgtgcactgtgtcctttagccagggccgtgccaacttatgaagacactgcagcttgagaggggctttgctgaggcttccccttggccatgtgaaagcccgccttgttgcctgctttgtgctttctgcaccagacaacctgatggaacatttgcacctgagttgtacatttttgaagtgtgcagggcagcctggacacaagcttagattctctatgtatagttccccgtgttcactaacatgccctctctggaaagcatatgtatataacatgtgtcatgtcctttggaaacctggtcacctggtgaaaacccttgggattcttccctgggcatgactgatgacaatttccatttcatcagtttgttttgttttcctttttctttaaatcttggactttaaaccctacctgtgtgattcagtagggtttgagacttacgtgtgatactgacaggtaagcaacagtgctagcattctagattcctgcctttttttaaaaagaaattattctcattgctgtattatattggaaaagttttaaacaaccaagctaaagctatgtgaaagttgagctcaaagtagaggaaaagttactggtggtaccttgctgcctgctctgctggtagaattctgtgctccccgtgacacttagtacattaagaatgactacactgttcctcgtatgtgaaggaggcagtgctgactccgtgagtgtgagacacgtgctttgaactgcttttctattcatggagcactccatagtctcaaactgtcccccttatgaccaacagcacatttgtgaagaggttcgcagggataaggggtgcactttatagctatggaaacatgagattctcctctattggaagctaattagcccacaaaggtggtaaacctgtagattgggccttaattagcattgtactctaatcaaaggactctttctaaaccatatttatagctttcttaacctacacatagtctatacatagatgcatattttacccccagctggctagagatttatttgttgtaaatgctgtatagatttggttttcctttctttacttaccctggtttggattttttttttttttcttttgaatggatttatgctgtcttagcaatatgacaataatcctctgtagcttgagctacccctcccctgctgtaacttacgtgacctgtgctgtcactgggcataggacagcggcatcacggttgcattcccattggactcatgcacctcccggatggtttttgtttttttcgggggttctttggggtttgtttgtttgcttcttttccagagtgtggaaagtctacagtgcagaaaggcttgaacctgccagctgatttgaaatactttcccctgcgcagggccgtatgcatcctgccaagctgcgttatattctgtactgtgtacaataaagaagtttgcttttcgtttaccaagcacccgaa

SEQ ID NO: 9885 - DNA, 573 bp, Homo sapiens
tttgcgggggcaggggggagatcggaaggggcgtccggccactggtccgacaggcccagccggctagagttcacgggctgattcagaatcttcaaagtcggggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagc

SEQ ID NO: 9886 - DNA, 554 bp, Homo sapiens
gtgcgtgagcgcgcctgcgccgccggggccgctgcaaggggaggagagaggccgcctcaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaaccccc

SEQ ID NO: 9887 - DNA, 2213 bp, Homo sapiens
ggagcgcgagtgcgggggctcccgagtggatgggggatcgcggagttgcgaggctttcacagtctctggagattcgagagccccgaggggacttggaggctcgcgagaagagacgcttggcggagctccgcagttgggaggagggggcgggaagcagtttgaggggaatgtctgagaggcgctgccccccagagcaccgggagggggtaaatgacacaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatagtatgtgacaatctgcatcgatcatggactactaaatgcctttacatagaa

SEQ ID NO: 9888 - DNA, 574 bp, Homo sapiens
agcatccccggagagaagatagagccgccccacggccttcacaggagggggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaacccccctctcacccacccatcagaatcccctattt

SEQ ID NO: 9889 - DNA, 1859 bp, Homo sapiens
agttgggaggagggggcgggaagcagtttgaggggaatgtctgagaggcgctgccccccagagcaccgggagggggtaaatgacacaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagata

SEQ ID NO: 9890 - DNA, 2211 bp, Homo sapiens
gcgtcccgggtccccgcgccgcgccgcgacctgcagaccccgccgccgcgctcgggcccgtctcccacgcccccgccgccccgcgcgcccaactccgccggccgccccgccccgccccgcgcgctccagacccccggggcggctgccgggagagatgctggaagaaacttcttaaatgaccgcgtctggctggccgtggagcctttctgggttggggagaggaaaggaaagtggaaaaaacctgagaacttcctgatctctctcgctgtgagacatgtctgagactcctgctcagtgtagcattaagcaggaacgaatttcatatacacctccagagagcccagtgccgagttacgcttcctcgacgccacttcatgttccagtgcctcgagcgctcaggatggaggaagactcgatccgcctgcctgcgcacctgcgcttgcagccaatttactggagcagggatgacgtagcccagtggctcaagtgggctgaaaatgagttttctttaaggccaattgacagcaacacgtttgaaatgaatggcaaagctctcctgctgctgaccaaagaggactttcgctatcgatctcctcattcaggtgatgtgctctatgaactccttcagcatattctgaagcagaggaaacctcggattcttttttcaccattcttccaccctggaaactctatacacacacagccggaggtcatactgcatcagaaccatgaagaagataactgtgtccagaggacccccaggccatccgtggataatgtgcaccataaccctcccaccattgaactgttgcaccgctccaggtcacctatcacgacaaatcaccggccttctcctgaccccgagcagcggcccctccggtcccccctggacaacatgatccgccgcctctccccggctgagagagctcagggacccaggccgcaccaggagaacaaccaccaggagtcctaccctctgtcagtgtctcccatggagaataatcactgcccagcgtcctccgagtcccacccgaagccatccagcccccggcaggagagcacacgcgtgatccagctgatgcccagccccatcatgcaccctctgatcctgaacccccggcactccgtggatttcaaacagtccaggctctccgaggacgggctgcatagggaagggaagcccatcaacctctctcatcgggaagacctggcttacatgaaccacatcatggtctctgtctccccgcctgaagagcacgccatgcccattgggagaatagcagactgtagactgctttgggattacgtctatcagttgctttctgacagccggtacgaaaacttcatccgatgggaggacaaagaatccaaaatattccggatagtggatcccaacggactggctcgactgtggggaaaccataagaacagaacaaacatgacctatgagaaaatgtccagagccctgcgccactactacaaactaaacattatcaggaaggagccaggacaaaggcttttgttcaggtttatgaaaaccccagatgaaatcatgagtggccgaacagaccgtctggagcacctagagtcccaggagctggatgaacaaatataccaagaagatgaatgctgaaggaaccaacagtccacctcagcgggccagcagcccagggaacccctgcccaccaggattgctggaagtgtgacggagcaggcgggctgaggagagtggaaaaggaagcgacccagaaatggcagggacacttctcttgcagaccaagagggaccctggagcaccttagacaaactacccagcacaggcggggctggaattctggcggagggcatgagcctgggactccatgtcacgtttccttctgatttggaatctctccatctgtaattcctcaccctcacccttccaccgttgttagtatcatggtgtttttgtttttgtttttgttttaagaacctgcagtttgactcttcatcgttcatctaggggaagacatctgatgttgttttcctatggaaatatatatctattatatatatattttttgcaaatctcacaaagtgcggcaagcccagctggtcaggaaagagaatacttgcagaggggttcaggttcctctttttcctgccacgtggatcaggtctgttcctgttactgttgggtcttggctgaaaaaaaaaaatgcttttaaaaaa

SEQ ID NO: 9891 - DNA, 1800 bp, Homo sapiens
gcgcacaacctctcttgagacagggggagctgagacagatggaaagggtgatgggtgggcaggcaccaaccccggagcacccagaggcccaggaaaaggtgtcagtcgggatctccgagtagtctggccctgctcaggagagcacagccgctctgatggtggtgcgacggttccggacctgtggggcctcagcggggccaaacggcaggccgagacagtatcggggccgggaaggtcactcacccctaaagggagaggcaccatgcgaggccccttcctatcctatgtgcggagactcacagggtccttcctggtcctgggctcgggaccgtgagagacgcagttggttccgagttcaggactaggggtccccttagatcctcagatcctgcagaatcccggctctgccccagtgggagccaaggccaggtcgccagagggactgtccgccggctggaggctgtgtgcaggacccacgcctcccaggctagcgagcgggcagcgccccggtgctgcgctcccacggggccggcccctgccctgccctgccctgctcctagcccgcagcggcgcaagtggaaccgcatcccgctctttcgttttcgtttcccggaaggatagcgattaccggagcgcctcgcgcgcctgcccgcctgcggaggacccgggcgcacacgccttggcgcttctcgaaagagatttcctcccacgcgaccttccagttctcggagccaggttaggggtttggcggaggaggactgcggggcgcgggcctagggccccagcagccacagccaggggagcgctcaagacagaaagccggtggcttcctcacctccacctgtaatgcaggagggagaattggctatttctcctataagccctgtggcagccatgcctcccctaggcacccacgtgcaagccagatgtgaagctcaaattaacctgctgggtgaaggggggatctgcaagctgccaggaagactccgcatccagcccgcactgtggagcagggaggacgtgctgcactggctgcgctgggcagagcaggagtactctctgccatgcaccgcggagcacgggttcgagatgaacggacgcgccctctgcatcctcaccaaggacgacttccggcaccgtgcgcccagctcaggtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagaaatggacttcagctgatcttcatattcatatggagtttccagtga

SEQ ID NO: 9892 - DNA, 1719 bp, Homo sapiens
gtttcccggaaggatagcgattaccggagcgcctcgcgcgcctgcccgcctgcggaggacccgggcgcacacgccttggcgcttctcgaaagagatttcctcccacgcgaccttccagttctcggagccaggttaggggtttggcggaggaggactgcggggcgcgggcctagggccccagcagccacagccaggggagcgctcaagacagaaagccggtggcttcctcacctccacctgtaatgcaggagggagaattggctatttctcctataagccctgtggcagccatgcctcccctaggcacccacgtgcaagccagatgtgaagctcaaattaacctgctgggtgaaggggggatctgcaagctgccaggaagactccgcatccagcccgcactgtggagcagggaggacgtgctgcactggctgcgctgggcagagcaggagtactctctgccatgcaccgcggagcacgggttcgagatgaacggacgcgccctctgcatcctcaccaaggacgacttccggcaccgtgcgcccagctcaggtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagatttctaaagactccgggaaagatggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgaggtacaggggaatggactctcccctactgcacccctgggagaggaagccaggcaccgatagagcacccagccccacccctgtaaatggaatttaccagatgaagggaatgaagtccctcactgagcctcagatttcctcacctgtgaaatgggctgaggcaggaaatgggaaaaagtgttagtgcttccaggcggcactgacagcctcagtaacaataaaaacaatggtagctga

SEQ ID NO: 9893 - DNA, 1488 bp, Homo sapiens
gtttcccggaaggatagcgattaccggagcgcctcgcgcgcctgcccgcctgcggaggacccgggcgcacacgccttggcgcttctcgaaagagatttcctcccacgcgaccttccagttctcggagccaggttaggggtttggcggaggaggactgcggggcgcgggcctagggccccagcagccacagccaggggagcgctcaagacagaaagccggtggcttcctcacctccacctgtaatgcaggagggagaattggctatttctcctataagccctgtggcagccatgcctcccctaggcacccacgtgcaagccagatgtgaagctcaaattaacctgctgggtgaaggggggatctgcaagctgccaggaagactccgcatccagcccgcactgtggagcagggaggacgtgctgcactggctgcgctgggcagagcaggagtactctctgccatgcaccgcggagcacgggttcgagatgaacggacgcgccctctgcatcctcaccaaggacgacttccggcaccgtgcgcccagctcaggtgacgtcctgtatgagctgctccagtacatcaagacccagcggcgagccctggtgtgtgggcccttttttggagggatcttcaggctgaagacgcccacccagcactctccagtccccccggaagactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagatttctaaagactccgggaaagatggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgaggtacaggggaatggactctcccctactgcacccctgggagaggaagccaggcaccgatagagcacccagccccacccctgtaaatggaatttaccagatgaagggaatgaagtccctcactgagcctcagatttcctcacctgtgaaatgggctgaggcaggaaatgggaaaaagtgttagtgcttccaggcggcactgacagcctcagtaacaataaaaacaatggtagctga

SEQ ID NO: 9894 - DNA, 2157 bp, Homo sapiens
gcgcacaacctctcttgagacagggggagctgagacagatggaaagggtgatgggtgggcaggcaccaaccccggagcacccagaggcccaggaaaaggtgtcagtcgggatctccgagtagtctggccctgctcaggagagcacagccgctctgatggtggtgcgacggttccggacctgtggggcctcagcggggccaaacggcaggccgagacagtatcggggccgggaaggtcactcacccctaaagggagaggcaccatgcgaggccccttcctatcctatgtgcggagactcacagggtccttcctggtcctgggctcgggaccgtgagagacgcagttggttccgagttcaggactaggggtccccttagatcctcagatcctgcagaatcccggctctgccccagtgggagccaaggccaggtcgccagagggactgtccgccggctggaggctgtgtgcaggacccacgcctcccaggctagcgagcgggcagcgccccggtgctgcgctcccacggggccggcccctgccctgccctgccctgctcctagcccgcagcggcgcaagtggaaccgcatcccgctctttcgttttcgtttcccggaaggatagcgattaccggagcgcctcgcgcgcctgcccgcctgcggaggacccgggcgcacacgccttggcgcttctcgaaagagatttcctcccacgcgaccttccagttctcggagccaggttaggggtttggcggaggaggactgcggggcgcgggcctagggccccagcagccacagccaggggagcgctcaagacagaaagccggtggcttcctcacctccacctgtaatgcaggagggagaattggctatttctcctataagccctgtggcagccatgcctcccctaggcacccacgtgcaagccagatgtgaagctcaaattaacctgctgggtgaaggggggatctgcaagctgccaggaagactccgtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagatttctaaagactccgggaaagatggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgaggtacaggggaatggactctcccctactgcacccctgggagaggaagccaggcaccgatagagcacccagccccacccctgtaaatggaatttaccagatgaagggaatgaagtccctcactgagcctcagatttcctcacctgtgaaatgggctgaggcaggaaatgggaaaaagtgttagtgcttccaggcggcactgacagcctcagtaacaataaaaacaatggtagctg

SEQ ID NO: 9895 - DNA, 1186 bp, Homo sapiens
cacacgccttggcgcttctcgaaagagatttcctcccacgcgaccttccagttctcggagccaggttaggggtttggcggaggaggactgcggggcgcgggcctagggccccagcagccacagccaggggagcgctcaagacagaaagccggtggcttcctcacctccacctgtaatgcaggtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagatttctaaagactccgggaaagatggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgaggtacaggggaatggactctcccctactgcacccctgggagaggaagccaggcaccgatagagcacccag

SEQ ID NO: 9896 - DNA, 2705 bp, Homo sapiens
attaacccgggaggcggcggcggggaggggagaggctctgagaggcgaggccgggtgaggcggcgagggcggcccgacgggcgcgggacgggacggggcagcgagggcgccgggagccgcggcccggaatcggggcgcttcgccccgggccccccagcatgaagaccccggcggacacagggtttgccttcccggattgggcctacaagccagagtcgtcccctggctcaaggcagatccagctgtggcactttatcctggagctgctgcggaaggaggagtaccagggcgtcattgcctggcagggggactacggggaattcgtcatcaaagaccctgatgaggtggcccggctgtggggcgttcgcaagtgcaagccccagatgaattacgacaagctgagccgggccctgcgctattactataacaagcgcattctgcacaagaccaaggggaaacggttcacctacaagttcaatttcaacaaactggtgctggtcaattacccattcattgatgtggggttggctgggggtgcagtgccccagagtgccccgccagtgccgtcgggtggtagccacttccgcttccctccctcaacgccctccgaggtgctgtcccccaccgaggacccccgctcaccaccagcctgctcttcatcttcatcttccctcttctcggctgtggtggcccgccgcctgggccgaggctcagtcagtgactgtagtgatggcacgtcagagctggaggaaccgctgggagaggatccccgcgcccgaccacccggccctccggatctgggtgccttccgagggcccccgctggcccgcctgccccatgaccctggtgtcttccgagtctatccccggcctcggggtggccctgaacccctcagccccttccctgtgtcgcctctggccggtcctggatccctgctgccccctcagctctccccggctctgcccatgacgcccacccacctggcctacactccctcgcccacgctgagcccgatgtaccccagtggtggcggggggcccagcggctcagggggaggctcccacttctccttcagccctgaggacatgaaacggtacctgcaggcccacacccaaagcgtctacaactaccacctcagcccccgcgccttcctgcactaccctgggctggtggtgccccagccccagcgccctgacaagtgcccgctgccgcccatggcacccgagaccccaccggtcccctcctcggcctcgtcatcctcttcttcttcttcctccccattcaagtttaagctccagccgcccccactcggacgccggcagcgggcagctggggagaaggccgtagccggtgctgacaagagcggtggcagtgcaggcgggctggctgagggggcaggggcgctagccccaccgcccccgccaccacagatcaaggtggagcccatctcggaaggcgagtcggaggaggtagaggtgactgacatcagtgatgaggatgaggaagacggggaggtgttcaagacgccccgtgccccacctgcaccccctaagcctgagcccggcgaggcacccggggcatcccagtgcatgcccctcaagctacgctttaagcggcgctggagtgaagactgtcgcctcgaagggggtgggggccccgctgggggctttgaggatgagggtgaggacaagaaggtgcgtggggaggggcctggggaggctggggggcccctcaccccaaggcgggtgagctctgacctccagcatgccacggcccagctctccctggagcaccgagactcctgagggctgtgggcaggggacctgtgtgccccgcaccccccatgcttcttttgctgccttaagccccctatgccctggaggtgagggcagctctcttgtctcttccctgcctcctcccttttccctccccacattttgtataaaactttaatttcttttttttaaaaatggtgggggtgggtgggtgcccagggctaggggctattccctgtctctgtgggtttctaagctctgggcaaagtggtggtagggggagggagggggaagttaagggggtcacctccattctggggaatttatatttgaattgaggctttggccttaacacccaggaacttttctattacaatcgcttaggaagtaaagccttgtctccctccctgttctctgcctcttgtacccctctgacccacccgctctgccccactcccagccctcctcagccccagccctgcctgccctgcccctccagggggccatgagtgcctaggtttctcataccccacaaggtcacagcaggggagggagggacaattttataatgaaccaaaaattccatgtgttggggggtggggggcggaggagggtgaggggtgccgcccatgggccacaaatctctacaagtgcctgctatccctctcccactccccaccccagcaccggtccaaccccttcatccccagctgctcctaggactggcccatgggcaggcgggtggggggatgggaagggggtgccctgaaaccaaactggaagccccctctgcctcccagctggggcctctggggtggggtggggggctgtggtcaagccttattctgtattggggactgagggtggggggagtagaggggccgctggagaatgtattcaaaacaataaaactttggacctttggatgca

SEQ ID NO: 9897 - DNA, 2032 bp, Homo sapiens
gtgcggggcgggggggctcgtccaccgggcccgctatccctggttctgcgctgcgcggtcctgctggtgaccttcacggcggcgcgtgccctgcaccagggtttgccttcccggattgggcctacaagccagagtcgtcccctggctcaaggcagatccagctgtggcactttatcctggagctgctgcggaaggaggagtaccagggcgtcattgcctggcagggggactacggggaattcgtcatcaaagaccctgatgaggtggcccggctgtggggcgttcgcaagtgcaagccccagatgaattacgacaagctgagccgggccctgcgctattactataacaagcgcattctgcacaagaccaaggggaaacggttcacctacaagttcaatttcaacaaactggtgctggtcaattacccattcattgatgtggggttggctgggggtgcagtgccccagagtgccccgccagtgccgtcgggtggtagccacttccgcttccctccctcaacgccctccgaggtgctgtcccccaccgaggacccccgctcaccaccagcctgctcttcatcttcatcttccctcttctcggctgtggtggcccgccgcctgggccgaggctcagtcagtgactgtagtgatggcacgtcagagctggaggaaccgctgggagaggatccccgcgcccgaccacccggccctccggatctgggtgccttccgagggcccccgctggcccgcctgccccatgaccctggtgtcttccgagtctatccccggcctcggggtggccctgaacccctcagccccttccctgtgtcgcctctggccggtcctggatccctgctgccccctcagctctccccggctctgcccatgacgcccacccacctggcctacactccctcgcccacgctgagcccgatgtaccccagtggtggcggggggcccagcggctcagggggaggctcccacttctccttcagccctgaggacatgaaacggtacctgcaggcccacacccaaagcgtctacaactaccacctcagcccccgcgccttcctgcactaccctgggctggtggtgccccagccccagcgccctgacaagtgcccgctgccgcccatggcacccgagaccccaccggtcccctcctcggcctcgtcatcctcttcttcttcttcctccccattcaagtttaagctccagccgcccccactcggacgccggcagcgggcagctggggagaaggccgtagccggtgctgacaagagcggtggcagtgcaggcgggctggctgagggggcaggggcgctagccccaccgcccccgccaccacagatcaaggtggagcccatctcggaaggcgagtcggaggaggtagaggtgactgacatcagtgatgaggatgaggaagacggggaggtgttcaagacgccccgtgccccacctgcaccccctaagcctgagcccggcgaggcacccggggcatcccagtgcatgcccctcaagctacgctttaagcggcgctggagtgaagactgtcgcctcgaagggggtgggggccccgctgggggctttgaggatgagggtgaggacaagaaggtgcgtggggaggggcctggggaggctggggggcccctcaccccaaggcgggtgagctctgacctccagcatgccacggcccagctctccctggagcaccgagactcctgagggctgtgggcaggggacctgtgtgccccgcaccccccatgcttcttttgctgccttaagccccctatgccctggaggtgagggcagctctcttgtctcttccctgcctcctcccttttccctccccacattttgtataaaactttaatttcttttttttaaaaatggtgggggtgggtgggtgcccagggctaggggctattccctgtctctgtgggtttctaagctctgggcaaagtggtggtagggggagggagggggaagttaagggggtcacctccattctggggaatttatatttgaattga

SEQ ID NO: 9898 - DNA, 2608 bp, Homo sapiens
gcgcgggaggggcggggccacgctgcgggcccgggccatggccgccgccgatgccgaggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcttgcttgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaagatacagaaaacttctaaagtttatacggagtctcaagagacccagagaagccaaacaattttgtga

SEQ ID NO: 9899 - DNA, 3589 bp, Homo sapiens
gcgcgggaggggcggggccacgctgcgggcccgggccatggccgccgccgatgccgaggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcttgcttgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataaggtaatctccgcc

SEQ ID NO: 9900 - DNA, 5095 bp, Homo sapiens
ggcggggccacgctgcgggcccgggccatggccgccgccgatgccgaggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcttgcttgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcaggcgggcgctaatattgacacctgctcagaagaccagaggaccccgttgatggaagcagccgaaaacaaccatctggaagcagtgaagtacctcatcaaggctggggccctggtggatcccaaggacgcagagggctctacgtgtttgcacctggctgccaagaaaggccactacgaagtggtccagtacctgctttcaaatggacagatggacgtcaactgtcaggatgacggaggctggacacccatgatctgggccacagagtacaagcacgtggacctcgtgaagctgctgctgtccaagggctctgacatcaacatccgagacaacgaggagaacatttgcctgcactgggcggcgttctccggctgcgtggacatagccgagatcctgctggctgccaagtgcgacctccacgccgtgaacatccacggagactcgccactgcacattgccgcccgggagaaccgctacgactgtgtcgtcctctttctttctcgggattcagatgtcaccttaaagaacaaggaaggagagacgcccctgcagtgtgcgagcctcaactctcaggtgtggagcgctctgcagatgagcaaggctctgcaggactcggcccccgacaggcccagccccgtggagaggatagtgagcagggacatcgctcgaggctacgagcgcatccccatcccctgtgtcaacgccgtggacagcgagccatgccccagcaactacaagtacgtctctcagaactgcgtgacgtcccccatgaacatcgacagaaatatcactcatctgcagtactgcgtgtgcatcgacgactgctcctccagcaactgcatgtgcggccagctcagcatgcgctgctggtacgacaaggatggccggctcctgccagagttcaacatggcggagcctcccttgatcttcgaatgcaaccacgcgtgctcctgctggaggaactgccgaaatcgcgtcgtacagaatggtctcagggcaaggctgcagctctaccggacgcgggacatgggctggggcgtgcggtccctgcaggacatcccaccaggcacctttgtctgcgagtatgttggggagctgatttcagactcagaagccgacgttcgagaggaagattcttacctctttgatctcgacaataaggacggggaggtttactgcatcgacgcgcggttctacgggaacgtcagccggttcatcaaccaccactgcgagcccaacctggtgcccgtgcgcgtgttcatggcccaccaggacctgcggttcccccggatcgccttcttcagcacccgcctgatcgaggccggcgagcagctcgggtttgactatggagagcgcttctgggacatcaaaggcaagctcttcagctgccgctgcggctcccccaagtgccggcactcgagcgcggccctggcccagcgtcaggccagcgcggcccaggaggcccaggaggacggcttgcccgacaccagctccgcggctgccgccgaccccctatgagacgccgccggccagcggggcgctcgggagccagggaccgccgcgtcgccgattagaggacgaggaggagagattccgcacgcaaccgaaagggtccttcggggctgcgccgccggcttcctggaggggtcggaggtgaggctgcagcccctgcgggcgggtgtggatgcctcccagccaccttcccagacctgcggcctcaccgcgggcccagtgcccaggctggagcgcacactttggtccgcgcgccagagacgctgggagtccgcactggcatcaccttctgagtttctgatgctgatttgtcgttgcgaagtttctcgtttcttcctctgacctccgaggtccccgctgcaccacggggttgctctgttctcctgtccggcccagactcttctgtgtggcgccgccgaagccaccgttagcgcgagctgctccgttcgccctgcccacggcctgcgtggctggggccgagtcccaggggccgcacggagggcacagtctcctgtcaggctcggagaggtcaggagaccgaccccaccactaactttggagaaaatgtgggtttgctttttaaaggaatcctatatctagtcctatatatcaaacctctaactgacgtttcttttcgaggaagtggcttggtgggtgcagcccccgccggttccgttgacgctggcaccttctgttgattttttaagccacatgctatgatgaataaactgatttattttctaccattactgaacattaggacaaacacaaaataaaaaacaaaacacagacaacggtgctgattctggtgtggtttctactcaccacgtgaaataaactatcaactgtataaagagaacaaagtgattttagaataaaatgcaggaaaaacttttttaaagatgttagtcttgtagcgtgaataaatttgccatcaccttttgtgtggtggcctggcaggtcatatacttttttttggcatatacctttttaaagactgtaattagtgcagtaacagtggggttttttttgtgcaactcttctaaaaacattcataatgcagtcatgtttatttttttctgttaaaatgtttttgacagttttaagagcagtcttttggctctgaccatttcttgttctgtttccaatgaaatcaataaaaaaaaagaagtacttt

SEQ ID NO: 9901 - DNA, 2707 bp, Homo sapiens
gcgcgggaggggcggggccacgctgcgggcccgggccatggccgccgccgatgccgaggcagttccggcgaggggggagcctcagcaggattgctgtgtgaaaaccgagctgctgggagaagagacacctatggctgccgatgaaggctcagcagagaaacaggcaggagaggcccacatggctgcggacggtgagaccaatgggtcttgtgaaaacagcgatgccagcagtcatgcaaatgctgcaaagcacactcaggacagcgcaagggtcaacccccaggatggcaccaacacactaactcggatagcggaaaatggggtttcagaaagagactcagaagcggcgaagcaaaaccacgtcactgccgacgactttgtgcagacttctgtcatcggcagcaacggatacatcttaaataagccggccctacaggcacagcccttgaggactaccagcactctggcctcttcgctgcctggccatgctgcaaaaacccttcctggaggggctggcaaaggcaggactccaagcgcttttccccagacgccagccgccccaccagccacccttggggaggggagtgctgacacagaggacaggaagctcccggcccctggcgccgacgtcaaggtccacagggcacgcaagaccatgccgaagtccgtcgtgggcctgcatgcagccagtaaagatcccagagaagttcgagaagctagagatcataaggaaccaaaagaggagatcaacaaaaacatttctgactttggacgacagcagcttttaccccccttcccatcccttcatcagtcgctacctcagaaccagtgctacatggccaccacaaaatcacagacagcttgcttgccttttgttttagcagctgcagtatctcggaagaaaaaacgaagaatgggaacctatagcctggttcctaagaaaaagaccaaagtattaaaacagaggacggtgattgagatgtttaagagcataactcattccactgtgggttccaagggggagaaggacctgggcgccagcagcctgcacgtgaatggggagagcctggagatggactcggatgaggacgactcagaggagctcgaggaggacgacggccatggtgcagagcaggcggccgcgttccccacagaggacagcaggacttccaaggagagcatgtcggaggctgatcgcgcccagaagatggacggggagtccgaggaggagcaggagtccgtggacaccggggaggaggaggaaggcggtgacgagtctgacctgagttcggaatccagcattaagaagaaatttctcaagaggaaaggaaagaccgacagtccctggatcaagccagccaggaaaaggaggcggagaagtagaaagaagcccagcggtgccctcggttctgagtcgtataagtcatctgcaggaagcgctgagcagacggcaccaggagacagcacagggtacatggaagtttctctggactccctggatctccgagtcaaaggaattctgtcttcacaagcagaagggttggccaacggtccagatgtgctggagacagacggcctccaggaagtgcctctctgcagctgccggatggaaacaccgaagagtcgagagatcaccacactggccaacaaccagtgcatggctacagagagcgtggaccatgaattgggccggtgcacaaacagcgtggtcaagtatgagctgatgcgcccctccaacaaggccccgctcctcgtgctgtgtgaagaccaccggggccgcatggtgaagcaccagtgctgtcctggctgtggctacttctgcacagcgggtaattttatggagtgtcagcccgagagcagcatctctcaccgtttccacaaagactgtgcctctcgagtcaataacgccagctattgtccccactgtggggaggagagctccaaggccaaagaggtgacgatagctaaagcagacaccacctcgaccgtgacaccagtccccgggcaggagaagggctcggccctggagggcagggccgacaccacaacgggcagtgctgccgggccaccactctcggaggacgacaagctgcagggtgcagcctcccacgtgcccgagggctttgatccaacgggacctgctgggcttgggaggccaactcccggcctttcccagggaccagggaaggaaaccttggagagcgctctcatcgccctcgactcggaaaaacccaagaagcttcgcttccacccaaagcagctgtacttctccgccaggcaaggggagcttcagaaggtgctcctcatgctggtggacggaattgaccccaacttcaaaatggagcaccagaataagcgctctccactgcacgccgcggcagaggctggacacgtggacatctgccacatgctggttcagttctgcaggctgggaagcccaaggtcgaggggctgcctttggtgacttatggtgaggacctcgtgctgttcccgaacacagccaggaaccacgccaagaggaagatgctccagcacagccttgctgtggaccaggccgcccacagggagcaggtccattcctgggggctgactccgcctttcagagaggcgtggctccatcttcacagcctcgtagcctcttaaaggcccagcctcaaaacctcattggggcccccagccccggtaaataaattgcattcagaccata

SEQ ID NO: 9902 - DNA, 4047 bp, Homo sapiens
ctcttctctcggccccagagatgcggggtctaccgagagggagggggttgatgcgggcccgggggaggggtcgtgcggcccctccgggcagccgaggccgcggaaggggggggccccacagaggaagaggtaggccccggagcctactctctcttcccagggcccaggcatcctggaccccccaactctctactgggctgaccagccctcctgtcccttgtctcccctcccagggggaggcccccgctgagatgggggcgctgctgctggagaaggaaaccagaggagccaccgagagagttcatggctctttgggggacacccctcgtagtgaagaaaccctgcccaaggccacccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcagaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 9903 - DNA, 3856 bp, Homo sapiens
atggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccacccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcagaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 9904 - DNA, 3965 bp, Homo sapiens
agcggcgatggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccacccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcagaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 9905 - DNA, 3856 bp, Homo sapiens
atggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccacccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 9906 - DNA, 3980 bp, Homo sapiens
tcggcccccagcgcaagcggcgatggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccacccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 9907 - DNA, 4129 bp, Homo sapiens
atgcggggtctaccgagagggagggggttgatgcgggcccgggggaggggtcgtgcggcccctccgggcagccgaggccgcggaaggggggggccccacagaggaagaggtaggccccggagcctactctctcttcccagggcccaggcatcctggaccccccaactctctactgggctgaccagccctcctgtcccttgtctcccctcccagggggaggcccccgctgagatgggggcgctgctgctggagaaggaaaccagaggagccaccgagagagttcatggctctttgggggacacccctcgtagtgaagaaaccctgcccaaggccacccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcagaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 9908 - DNA, 4129 bp, Homo sapiens
atgcggggtctaccgagagggagggggttgatgcgggcccgggggaggggtcgtgcggcccctccgggcagccgaggccgcggaaggggggggccccacagaggaagaggtaggccccggagcctactctctcttcccagggcccaggcatcctggaccccccaactctctactgggctgaccagccctcctgtcccttgtctcccctcccagggggaggcccccgctgagatgggggcgctgctgctggagaaggaaaccagaggagccaccgagagagttcatggctctttgggggacacccctcgtagtgaagaaaccctgcccaaggccacccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 9909 - DNA, 4047 bp, Homo sapiens
ctcttctctcggccccagagatgcggggtctaccgagagggagggggttgatgcgggcccgggggaggggtcgtgcggcccctccgggcagccgaggccgcggaaggggggggccccacagaggaagaggtaggccccggagcctactctctcttcccagggcccaggcatcctggaccccccaactctctactgggctgaccagccctcctgtcccttgtctcccctcccagggggaggcccccgctgagatgggggcgctgctgctggagaaggaaaccagaggagccaccgagagagttcatggctctttgggggacacccctcgtagtgaagaaaccctgcccaaggccacccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 9910 - DNA, 4129 bp, Homo sapiens
atgcggggtctaccgagagggagggggttgatgcgggcccgggggaggggtcgtgcggcccctccgggcagccgaggccgcggaaggggggggccccacagaggaagaggtaggccccggagcctactctctcttcccagggcccaggcatcctggaccccccaactctctactgggctgaccagccctcctgtcccttgtctcccctcccagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 9911 - DNA, 894 bp, Homo sapiens
gagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccagggccagctgcccccaccctcactcccttcccacccacaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacat

SEQ ID NO: 9912 - DNA, 3965 bp, Homo sapiens
agcggcgatggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 9913 - DNA, 894 bp, Homo sapiens; identical to SEQ ID NO: 9911

SEQ ID NO: 9914 - DNA, 3856 bp, Homo sapiens; identical to SEQ ID NO: 9903

SEQ ID NO: 9915 - DNA, 4129 bp, Homo sapiens; identical to SEQ ID NO: 9907

SEQ ID NO: 9916 - DNA, 3965 bp, Homo sapiens; identical to SEQ ID NO: 9912

SEQ ID NO: 9917 - DNA, 894 bp, Homo sapiens; identical to SEQ ID NO: 9911

SEQ ID NO: 9918 - DNA, 3094 bp, Homo sapiens
tctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 9919 - DNA, 4047 bp, Homo sapiens
ctcttctctcggccccagagatgcggggtctaccgagagggagggggttgatgcgggcccgggggaggggtcgtgcggcccctccgggcagccgaggccgcggaaggggggggccccacagaggaagaggtaggccccggagcctactctctcttcccagggcccaggcatcctggaccccccaactctctactgggctgaccagccctcctgtcccttgtctcccctcccagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 9920 - DNA, 4047 bp, Homo sapiens; identical to SEQ ID NO: 9902

SEQ ID NO: 9921 - DNA, 3965 bp, Homo sapiens; identical to SEQ ID NO: 9904

SEQ ID NO: 9922 - DNA, 894 bp, Homo sapiens; identical to SEQ ID NO: 9911

SEQ ID NO: 9923 - DNA, 4129 bp, Homo sapiens; identical to SEQ ID NO: 9907

SEQ ID NO: 9924 - DNA, 2992 bp, Homo sapiens
tctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 9925 - DNA, 3856 bp, Homo sapiens
atggcggcggcggcgggagctgcagcggcggcggccgccgagggggaggcccccgctgagatgggggcgctgctgctggagaaggaaaccagaggagccaccgagagagttcatggctctttgggggacacccctcgtagtgaagaaaccctgcccaaggccaaccccgactccctggagcctgctggcccctcatctccagcctctgtcactgtcactgttggtgatgagggggctgacacccctgtaggggctacaccactcattggggatgaatctgagaatcttgagggagatggggacctccgtgggggccggatcctgctgggccatgccacaaagtcattcccctcttcccccagcaaggggggttcctgtcctagccgggccaagatgtcaatgacaggggcgggaaaatcacctccatctgtccagagtttggctatgaggctactgagtatgccaggagcccagggagctgcagcagcagggtctgaaccccctccagccaccacgagcccagagggacagcccaaggtccaccgagcccgcaaaaccatgtccaaaccaggaaatggacagcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggtaataaa

SEQ ID NO: 9926 - DNA, 3415 bp, Homo sapiens
tcatgccactgcactccatcctggcccccggtccctgagaagcggccccctgaaatacagcatttccgcatgagtgatgatgtccactcactgggaaaggtgacctcagatctggccaaaaggaggaagctgaactcaggaggtggcctgtcagaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgtgagtgagcgtttggttgaggaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggt

SEQ ID NO: 9927 - DNA, 4047 bp, Homo sapiens; identical to SEQ ID NO: 9902

SEQ ID NO: 9928 - DNA, 4129 bp, Homo sapiens; identical to SEQ ID NO: 9910

SEQ ID NO: 9929 - DNA, 894 bp, Homo sapiens; identical to SEQ ID NO: 9911

SEQ ID NO: 9930 - DNA, 894 bp, Homo sapiens; identical to SEQ ID NO: 9911

SEQ ID NO: 9931 - DNA, 3965 bp, Homo sapiens; identical to SEQ ID NO: 9904

SEQ ID NO: 9932 - DNA, 3856 bp, Homo sapiens; identical to SEQ ID NO: 9903

SEQ ID NO: 9933 - DNA, 4047 bp, Homo sapiens; identical to SEQ ID NO: 9919

SEQ ID NO: 9934 - DNA, 894 bp, Homo sapiens; identical to SEQ ID NO: 9911

SEQ ID NO: 9935 - DNA, 3856 bp, Homo sapiens; identical to SEQ ID NO: 9925

SEQ ID NO: 9936 - DNA, 2992 bp, Homo sapiens; identical to SEQ ID NO: 9924

SEQ ID NO: 9937 - DNA, 3094 bp, Homo sapiens; identical to SEQ ID NO: 9918

SEQ ID NO: 9938 - DNA, 3415 bp, Homo sapiens
tcatgccactgcactccatccaggcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgtgagtgagcgtttggttgaggaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggt

SEQ ID NO: 9939 - DNA, 3415 bp, Homo sapiens; identical to SEQ ID NO: 9926

SEQ ID NO: 9940 - DNA, 3415 bp, Homo sapiens
tcatgccactgcactccatcctggcccccggtccctgagaagcggccccctgaaatacagcatttccgcatgagtgatgatgtccactcactgggaaaggtgacctcagatctggccaaaaggaggaagctgaactcaggaggtggcctgtcggaggagttaggttctgcccggcgttcaggagaagtgaccctgacgaaaggggaccccgggtccctggaggagtgggagacggtggtgggtgatgacttcagtctctactatgattcctactctgtggatgagcgcgtggactccgacagcaagtctgaagttgaagctctaactgaacaactaagtgaagaggaggaggaggaagaggaggaagaagaagaagaggaagaggaggaggaagaggaagaagaagaggaagatgaggagtcagggaatcagtcagataggagtggttccagtggccggcgcaaggccaagaagaaatggcgaaaagacagcccatgggtgaagccgtctcggaaacggcgcaagcgggagcctccgcgggccaaggagccacgaggagtgaatggtgtgggctcctcaggccccagtgagtacatggaggtccctctggggtccctggagctgcccagcgaggggaccctctcccccaaccacgctggggtgtccaatgacacatcttcgctggagacagagcgagggtttgaggagttgcccctgtgcagctgccgcatggaggcacccaagattgaccgcatcagcgagagggcggggcacaagtgcatggccactgagagtgtggacggagagctgtcaggctgcaatgccgccatcctcaagcgggagaccatgaggccatccagccgtgtggccctgatggtgctctgtgagacccaccgcgcccgcatggtcaaacaccactgctgcccgggctgcggctacttctgcacggcgggcaccttcctggagtgccaccctgacttccgtgtggcccaccgcttccacaaggcctgtgtgtctcagctgaatgggatggtcttctgtccccactgtggggaggatgcttctgaagctcaagaggtgaccatcccccggggtgacggggtgaccccaccggccggcactgcagctcctgcacccccacccctgtcccaggatgtccccgggagagcagacacttctcagcccagtgcccggatgcgagggcatggggaaccccggcgcccgccctgcgatcccctggctgacaccattgacagctcagggccctccctgaccctgcccaatgggggctgcctttcagccgtggggctgccactggggccaggccgggaggccctggaaaaggccctggtcatccaggagtcagagaggcggaagaagctccgtttccaccctcggcagttgtacctgtccgtgaagcagggcgagctgcagaaggtgatcctgatgctgttggacaacctggaccccaacttccagagcgaccagcagagcaagcgcacgcccctgcatgcagccgcccagaagggctccgtggagatctgccatgtgctgctgcaggctggagccaacataaatgcagtggacaaacagcagcggacgccactgatggaggccgtggtgaacaaccacctggaggtagcccgttacatggtgcagcgtggtggctgtgtctatagcaaggaggaggacggttccacctgcctccaccacgcagccaaaatcgggaacttggagatggtcagcctgctgctgagcacaggacaggtggacgtcaacgcccaggacagtggggggtggacgcccatcatctgggctgcagagcacaagcacatcgaggtgatccgcatgctactgacgcggggcgccgacgtcaccctcactgacaacgtgagtgagcgtttggttgaggaggagaacatctgcctgcactgggcctccttcacgggcagcgccgccatcgccgaagtccttctgaatgcgcgctgtgacctccatgctgtcaactaccatggggacacccccctgcacatcgcagctcgggagagctaccatgactgcgtgctgttattcctgtcacgtggggccaaccctgagctgcggaacaaagagggggacacagcatgggacctgactcccgagcgctccgacgtgtggtttgcgcttcaactcaaccgcaagctccgacttggggtgggaaatcgggccatccgcacagagaagatcatctgccgggacgtggctcggggctatgagaacgtgcccattccctgtgtcaacggtgtggatggggagccctgccctgaggattacaagtacatctcagagaactgcgagacgtccaccatgaacatcgatcgcaacatcacccacctgcagcactgcacgtgtgtggacgactgctctagctccaactgcctgtgcggccagctcagcatccggtgctggtatgacaaggatgggcgattgctccaggaatttaacaagattgagcctccgctgattttcgagtgtaaccaggcgtgctcatgctggagaaactgcaagaaccgggtcgtacagagtggcatcaaggtgcggctacagctctaccgaacagccaagatgggctggggggtccgcgccctgcagaccatcccacaggggaccttcatctgcgagtatgtcggggagctgatctctgatgctgaggctgatgtgagagaggatgattcttacctcttcgacttagacaacaaggatggagaggtgtactgcatagatgcccgttactatggcaacatcagccgcttcatcaaccacctgtgtgaccccaacatcattcccgtccgggtcttcatgctgcaccaagacctgcgatttccacgcatcgccttcttcagttcccgagacatccggactggggaggagctagggtttgactatggcgaccgcttctgggacatcaaaagcaaatatttcacctgccaatgtggctctgagaagtgcaagcactcagccgaagccattgccctggagcagagccgtctggcccgcctggacccacaccctgagctgctgcccgagctcggctccctgccccctgtcaacacatgagaacggaccacaccctctctccccagcatggatggccacagctcagccgcctcctctgccaccagctgctcgcagcccatgcctgggggtgctgccatcttctctccccaccaccctttcacacattcctgaccagagatcccagccaggccctggaggtctgacagcccctccctcccagagctggttcctccctgggagggcaacttcagggctggccaccccccgtgttccccatcctcagttgaagtttgatgaattgaagtcgggcctctatgccaactggttccttttgttctcaataaatgttgggtttggt

SEQ ID NO: 9941 - DNA, 3415 bp, Homo sapiens; identical to SEQ ID NO: 9938

SEQ ID NO: 9942 - DNA, 3415 bp, Homo sapiens; identical to SEQ ID NO: 9926

SEQ ID NO: 9943 - DNA, 5276 bp, Homo sapiens
cccagcttcagcctcagctcccctccttcctggatcgagcgcccgcactcccggccctgcagccacccgagtcccgctcgctgtcgcctgcacgcgagtcccccctggcacgcgctcccacatcccgggatcgtcccaacggcccctgcgcccttcctgggatcactccgactgccccgcgcgccctgggatcggtccatctaccccgcgtggccccagctgcttgcccggagcgccagctagcgctccccgctctccgctccccggcactctcggggggcccgcccgccctgcaccctggagctccgggccgcgagcctctgccaactcctctggaccctcgcggccgtgggcagcggctgccgcgcctgtctgcccgagggaggaccttcgcctctgcatttgtccagtaactctggctgtgccggatactgcttgggtaaaacgggcaccccaggaacatggcagacgaagatctcatcttccgcctggaaggcgttgatggcggccagtccccccgagctggccatgatggtgattctgatggggacagcgacgatgaggaaggttacttcatctgccccatcacggatgacccaagctcgaaccagaatgtcaattccaaggttaataagtactacagcaacctaacaaaaagtgagcggtatagctccagcgggtccccggcaaactccttccacttcaaggaagcctggaagcacgcaatccagaaggccaagcacatgcccgacccctgggctgagttccacctggaagatattgccaccgaacgtgctactcgacacaggtacaacgccgtcaccggggaatggctggatgatgaagttctgatcaagatggcatctcagcccttcggccgaggagcaatgagggagtgcttccggacgaagaagctctccaacttcttgcatgcccagcagtggaagggcgcctccaactacgtggcgaagcgctacatcgagcccgtagaccgggatgtgtactttgaggacgtgcgtctacagatggaggccaagctctggggggaggagtataatcggcacaagccccccaagcaggtggacatcatgcagatgtgcatcatcgagctgaaggacagaccgggcaagcccctcttccacctggagcactacatcgagggcaagtacatcaagtacaactccaactctggctttgtccgcgatgacaacatccgcctgacgccgcaggccttcagccacttcacttttgagcgttccggccatcagctgatagtggtggacatccagggagttggggatctctacactgacccacagatccacacggagacgggcactgactttggagacggcaacctaggtgtccgcgggatggcgctcttcttctactctcatgcctgcaaccggatttgcgagagcatgggccttgctccctttgacctctcgccccgggagagggatgcagtgaatcagaacaccaagctgctgcaatcagccaagaccatcttgagaggaacagaggaaaaatgtgggagcccccaagtaaggaccctctctgggagccggccacccctgctccgtcccctttcagagaactctggagacgagaacatgagcgacgtgaccttcgactctctcccttcttccccatcttcggccacaccacacagccagaagctagaccacctccattggccagtgttcagtgacctcgataacatggcatccagagaccatgatcatctagacaaccaccgggagtctgagaatagtggggacagcggataccccagtgagaagcggggtgagctggatgaccctgagccccgagaacatggccactcatacagtaatcggaagtacgagtctgacgaagacagcctgggcagctctggacgggtatgtgtagagaagtggaatctcctcaactcctcccgcctccacctgccgagggcttcggccgtggccctggaagtgcaaaggcttaatgctctggacctcgaaaagaaaatcgggaagtccattttggggaaggtccatctggccatggtgcgctaccacgagggtgggcgcttctgcgagaagggcgaggagtgggaccaggagtcggctgtcttccacctggagcacgcagccaacctgggcgagctggaggccatcgtgggcctgggactcatgtactcgcagttgcctcatcacatcctagccgatgtctctctgaaggagacagaagagaacaaaaccaaaggatttgattacttactaaaggccgctgaagctggcgacaggcagtccatgatcctagtggcgcgagcttttgactctggccagaacctcagcccggacaggtgccaagactggctagaggccctgcactggtacaacactgccctggagatgacggactgtgatgagggcggtgagtacgacggaatgcaggacgagccccggtacatgatgctggccagggaggccgagatgctgttcacaggaggctacgggctggagaaggacccgcagagatcaggggacttgtatacccaggcagcagaggcagcgatggaagccatgaagggccgactggccaaccagtactaccaaaaggctgaagaggcctgggcccagatggaggagtaaccaggaaaatcactgccggctagtcccaagcaaacgggctaggaggaaagattaaaaaaacaacaacaacaacttatttagtttggggaggggaagcatttttaagtgtgttgtaaaatcaaattttatatttcattttttgactcttgaaaaatgtctttgctccttggcagctaccagcagagactctatagctgtctcttagggcagtattttggggaagtggggcttgaagaagcagcctaatgaaccaacataccgttttgtgtgtggttttttttgtttgtttgtttgtttgttttgagacagagtcttgctctgtcacccaggctggagtgcagtgacatgatcttagctcactgcaacctccgcctcctgggttcaagtgattctcctgcctcagcctcccaagtagctgggattactggtgcacaccaccacactcagctaatttttgcatttttagtagagatggggtttcaccatgttggccaggctggtctcgaactcctaacctcaggtgatccacctgcctcagcctcccaaagtgctgggattacaggtgtgagccaccatgcctgcccattttgtggttctattttcatttttatttctttttttttttttgtcacgagatataagaaagtgctttttgccttgaatggacaattttagggctgtgctcactagtcttttcaggctggactgaaatgtcgggcccatggagccctgtgttttgtgcatcgggatgagaaatgaagcacttcacgctggctttcctaagtcacggggcgtgtattgccgtggcttagtgcaaagcattctttctcagagcatttagaggcatgcgtggcattttttcagtgggtgtgagattgcacaatacccaggctcccttctactgtggggaagggcctgcatgttggctgttttttaaacttctagttcaatttccttccataatgctactgattttctggcatacagccgaattccatcttttaagcatgctttctacggtgggcttttcaaaacaggtttgagttttgtatgcacacgtttactacctctaactcctacatcagctagtgtggaagagggtgcacctcaaagcttttacacgtaaggacagcggcttggaatgtgagagccttttctccaagcagacccacactctgcatctcagtggcagctcccacaacgtgactgcaatgtctcttatacagtattccttggtgttttcttagtgtctggatgttcttacgtgaaatctgctccccagccctggtccttggcattttctgcttgaagctgggctgattttcttgtaatttacagcaggacgctttcagcagcagtctcttgggattttatctaagatgtttgaggatgagagggcaagaactataaacactcattaattctagtagtctccccatggccagacaatggcgattgttatttaatgagcttttcctttcaatggaattcagctctcacattagtatgatttcatttgatgtttcaaatagcaaagatgctaggtgcggtggctcccgcctgtaatctcagcactttgaggagggccaaggtgggaggattgcttgagctcaggacttcaagaccagcctgggtaaacatggcgagaccctgtctctaccaaaacaacaaaaaaaagacagactgctttgatcaaccctaaatgcaaaagcagcctatttttctttgtttaaaagtcaaaacataaaaaagcagagtataacatacaaaccattcttaactattcattaaaatgggtccttcaacaccttagtggggtttgttgttgttgcttatgcagagagattattttctttttattattttataatttttgaaatagagatggggtctcactgtgttgcccaggctggtctcgaactcctggacttaagtgagcctcccgcctcagtctcccaaagcgctgggattacaggcaggagccactgagcccagccaagacttcagtgttgactgctttggaggcacaaacccatgcaagcgttagttccaaagttcagtgtgtacccttaaatgaacaatgaagcaggtaaaattacccttgaaaaaaatcccttggaccacccataaatgacagtgactttttcaatatggactcatcatagccagttttccttttgaagttggaactgatcacccttttgtcatctgtaccagatcagtagttggcttgtgttacattttgtgtgtgtgtgtgcgtgttttaaaccagtgcatataaattgtatgttaaatgtaagtaactttaagttgacttatctcttcacagtaatcaagcctcacgtaattcatgctttttaaattcagccagccccccctctctgaaattttattatgtaaataatttgtgttccctgatcactcgtttaagttcttagttgtatgtcatctcttctctagcaggaattggcaaacttttttgtaaaggggtagaaagtgaagattttaggctttgcaggccatatagcctctgctgcaaatgctcagccctgctgttgtaatgtaaaagctgccacagacactacatgaacacgaatgagtgtggctggtgttccaataaaactttatttacacaaa

SEQ ID NO: 9944 - DNA, 2303 bp, Homo sapiens
cgcagaggaagacgctctagggatttgtcccggactagcgagatggcaaggctgaggacgggaggctgattgagaggcgaaggtacaccctaatctcaatacaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaa

SEQ ID NO: 9945 - DNA, 4441 bp, Homo sapiens
gtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaacctgtgtgttcctttggtcaacaccgagacatttaggtgaaagacatctaattctggttttacgaatctggaaacttcttgaaaatgtaattcttgagttaacacttctgggtggagaatagggttgttttccccccacataattggaaggggaaggaatatcatttaaagctatgggagggttgctttgattacaacactggagagaaatgcagcatgttgctgattgcctgtcactaaaacaggccaaaaactgagtccttgtgttgcatagaaagcttcatgttgctaaaccaatgttaagtgaatctttggaaacaaaatgtttccaaattactgggatgtgcatgttgaaacgtgggttaaaatgactgggcagtgaaagttgactatttgccatgacataagaaataagtgtagtggctagtgtacaccctatgagtggaagggtccattttgaagtcagtggagtaagctttatgccagtttgatggtttcacaagttctattgagtgctattcagaataggaacaaggttctaatagaaaaagatggcaatttgaagtagctataaaattagactaatctacattgcttttctcctgcagagtctaataccttttatgctttgataattagcagtttgtctacttggtcactaggaatgaaactacatggtaataggcttaacaggtgtaatagcccacttactcctgaatctttaagcatttgtgcatttgaaaaatgcttttcgcgatcttcctgctgggattacaggcatgagccactgtgcctgacctcccatatgtaaaagtgtctaaaggtttttttttggttataaaaggaaaatttttgcttaagtttgaaggataggtaaaattaaaggacatgctttctgtttgtgtgatggtttttaaaaattttttttaagatggagttcttgttgcccaggctagaatgcaatggcaaaatctcactgcaatctcctcctcctgggttcaagcaattctcctacttcagcctcccaagtagctgggattacaggcatgtgctaatttggtgtttttaatagagatgaggtttttccatgttggtcaggctggtctcaaactcctgaccttaggtgatcgcctcggcctcctaaagtgctggaattacaggcatgagccaccatgcctggccaggacatgtgttcttaaggacatgctaagcaggagttaaagcagcccaagagataaggcctcttaaagtgactggcaatgtgtattgctcaagattcaaaggtacttgaattggccatagacaagtctgtaatgaagtgttatcgttttccctcatctgagtctgaattagataaaatgccttcccatcagccagtgctctgaggtatcaagtctaaattgaactagagatttttgtccttagtttctttgctatctaatgtttacacaagtaaatagtctaagatttgctggatgacagaaaaaacaggtaaggcctttaatagatggccaatagatgccctgataatgaaagttgacacctgtaagatttaccagtagagaattcttgacatgcaaggaagcaagatttaactgaaaaattgttcccactggaagcaggaatgagtcagtttacttgcatatactgagattgagattaacttcctgtgaaacccagtgtcttagacaactgtggcttgagcaccacctgctggtattcattacaaacttgctcactacaataaatgaattttaagctttaa

SEQ ID NO: 9946 - DNA, 1923 bp, Homo sapiens
cgttaaggaggcccccagtcccgacccttcgccccaagcccctcggggtccccgggcctggtactccttgccacacgggaggggcgcggaagccggggcggaggaggagccaaccccgggctgggctgagacccgcagaggaagacgctctagggatttgtcccggactagcgagatggcaaggctgaggacgggaggctgattgagaggcgaaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaat

SEQ ID NO: 9947 - DNA, 635 bp, Homo sapiens
gtaggactgagtctattctaaactgaaagcctggacatctggagtaccagggggagatgacgtgttacgggcttccataaaagcagctggctttgaatggaaggagccaagaggccagcacaggagcggattcgtcgctttcacggccatcgagccgaacctctcgcaagtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtga

SEQ ID NO: 9948 - DNA, 3459 bp, Homo sapiens
ccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttccgagtggagactggtgttctcccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtaagtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaacctgtgtgttcctttggtcaacaccgagacatttaggtgaaagacatctaattctggttttacgaatctggaaacttcttgaaaatgtaattcttgagttaacacttctgggtggagaatagggttgttttccccccacataattggaaggggaaggaatatcatttaaagctatgggagggttgctttgattacaacactggagagaaatgcagcatgttgctgattgcctgtcactaaaacaggccaaaaactgagtccttgtgttgcatagaaagcttcatgttgctaaaccaatgttaagtgaatctttggaaacaaaatgtttccaaattactgggatgtgcatgttgaaacgtgggttaaaatgactgggcagtgaaagttgactatttgccatgacataagaaataagtgtagtggctagtgtacaccctatgagtggaagggtccattttgaagtcagtggagtaagctttatgccagtttgatggtttcacaagttctattgagtgctattcagaataggaacaaggttctaatagaaaaagatggcaatttgaagtagctataaaattagactaatctacattgcttttctcctgcagagtctaataccttttatgctttgataattagcagtttgtctacttggtcactaggaatgaaactacatggtaataggcttaacaggtgtaatagcccacttactcctgaatctttaagcatttgtgcatttgaaaaatgcttttcgcgatcttcctgctgggattacaggcatgagccactgtgcctgacctcccatatgtaaaagtgtctaaaggtttttttttggttataaaaggaaaatttttgcttaagtttgaaggataggtaaaattaaaggacatgctttctgtttgtgtgatggtttttaaaaattttttttaagatggagttcttgttgcccaggctagaatgcaatggcaaaatctcactgcaatctcctcctcctgggttcaagcaattctcctacttcagcctcccaagtagctgggattacaggcatgtgctaatttggtgtttttaatagagatgaggtttttccatgttggtcaggctggtctcaaactcctgaccttaggtgatcgcctcggcctcctaaagtgctggaattacaggcatgagccaccatgcctggccaggacatgtgttcttaaggacatgctaagcaggagttaaagcagcccaagagataaggcctcttaaagtgactggcaatgtgtattgctcaagattcaaaggtacttgaattggccatagacaagtctgtaatgaagtgttatcgttttccctcatctgagtctgaattagataaaatgccttcccatcagccagtgctctgaggtatcaagtctaaattgaactagagatttttgtccttagtttctttgctatctaatgtttacacaagtaaatagtctaagatttgctggatgacagaaaaaacaggtaaggcctttaatagatggccaatagatgccctgataatgaaagttgacacctgtaagatttaccagtagagaattcttgacatgcaaggaagcaagatttaactgaaaaattgttcccactggaagcaggaatgagtcagtttacttgcatatactgagattgagattaacttcctgtgaaacccagtgtcttagacaactgtggcttgagcaccacctgctggtattcattacaaacttgctcactacaataaatgaattttaagcttt

SEQ ID NO: 9949 - DNA, 1635 bp, Homo sapiens
caggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccatt

SEQ ID NO: 9950 - DNA, 701 bp, Homo sapiens
ctgacgctgcggaggctcgagcggcgtatccataccacccagctgttcgccgcgggaacccgccggcccgcaggtgacccagcgctggaaaaacgccagcgacgtggcctggcgagctggcgcggggcaaggaccacccgcgcccgccttgccgccccagcctccctccctaggaagcagggtgcgccccggtgcgcgcggggcttccccggaccggcgttccagtccctctccggcttccggcccaccccggccccactgagagcagaaatgtgatctctgccctgagaaaatgctcgtggccagtgactacccctaacgcacaataatatggctccgatgggctcaaaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatc

SEQ ID NO: 9951 - DNA, 1328 bp, Homo sapiens
gtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccacaaagcagtggacaagaaggctgctggagctggcaaggtcaccaagtctgcccagaaagctcagaaggctaaatgaatattatccctaa

SEQ ID NO: 9952 - DNA, 1843 bp, Homo sapiens
actgcgccgccaccgtcaataggtggaccccctcccggagataaaaccgccggcgccggcgccgccagtccctctggctgagacctcggctccggaatcactgcagcccccctcgccctgagccagagcaccccgggtcccgccagcccctcacactcccagcaaaatgggcaaggagaagacccacatcaacatcgtggtcatcggccacgtggactccggaaagtccaccaccacgggccacctcatctacaaatgcggaggtattgacaaaaggaccattgagaagttcgagaaggaggcggctgagatggggaagggatccttcaagtatgcctgggtgctggacaagctgaaggcggagcgtgagcgcggcatcaccatcgacatctccctctggaagttcgagaccaccaagtactacatcaccatcatcgatgcccccggccaccgcgacttcatcaagaacatgatcacgggtacatcccaggcggactgcgcagtgctgatcgtggcggcgggcgtgggcgagttcgaggcgggcatctccaagaatgggcagacgcgggagcatgccctgctggcctacacgctgggtgtgaagcagctcatcgtgggcgtgaacaaaatggactccacagagccggcctacagcgagaagcgctacgacgagatcgtcaaggaagtcagcgcctacatcaagaagatcggctacaacccggccaccgtgccctttgtgcccatctccggctggcacggtgacaacatgctggagccctcccccaacatgccgtggttcaagggctggaaggtggagcgtaaggagggcaacgcaagcggcgtgtccctgctggaggccctggacaccatcctgccccccacgcgccccacggacaagcccctgcgcctgccgctgcaggacgtgtacaagattggcggcattggcacggtgcccgtgggccgggtggagaccggcatcctgcggccgggcatggtggtgacctttgcgccagtgaacatcaccactgaggtgaagtcagtggagatgcaccacgaggctctgagcgaagctctgcccggcgacaacgtcggcttcaatgtgaagaacgtgtcggtgaaggacatccggcggggcaacgtgtgtggggacagcaagtctgacccgccgcaggaggctgctcagttcacctcccaggtcatcatcctgaaccacccggggcagattagcgccggctactccccggtcatcgactgccacacagcccacatcgcctgcaagtttgcggagctgaaggagaagattgaccggcgctctggcaagaagctggaggacaaccccaagtccctgaagtctggagacgcggccatcgtggagatggtgccgggaaagcccatgtgtgtggagagcttctcccagtacccgcctctcggccgcttcgccgtgcgcgacatgaggcagacggtggccgtaggcgtcatcaagaacgtggagaagaagagcggcggcgccggcaaggtcaccaagtcggcgcagaaggcgcagaaggcgggcaagtgaagcgcgggcgcccgcggcgcgaccctccccggcggtgccgcgctccgaaccccgggcccgggcccccgccccgcccccgccccgcgcgccggtccggcgccccgcacccccgccaggcgcatgtctgcacctccgcttgccagaggccctcggtcagcgactggatgctcgccatcaaggtccagtggaagttcttcaagaggaaaggcgcccccgccccaggcttccgcgcccagcgctcgccacgctcagtgcccgttttaccaataaactgagcgaccccag

SEQ ID NO: 9953 - DNA, 1748 bp, Homo sapiens
aatcactgcagcccccctcgccctgagccagagcaccccgggtcccgccagcccctcacactcccagcaaaatgggcaaggagaagacccacatcaacatcgtggtcatcggccacgtggactccggaaagtccaccaccacgggccacctcatctacaaatgcggaggtattgacaaaaggaccattgagaagttcgagaaggaggcggctgagatggggaagggatccttcaagtatgcctgggtgctggacaagctgaaggcggagcgtgagcgcggcatcaccatcgacatctccctctggaagttcgagaccaccaagtactacatcaccatcatcgatgcccccggccaccgcgacttcatcaagaacatgatcacgggtacatcccaggcggactgcgcagtgctgatcgtggcggcgggcgtgggcgagttcgaggcgggcatctccaagaatgggcagacgcgggagcatgccctgctggcctacacgctgggtgtgaagcagctcatcgtgggcgtgaacaaaatggactccacagagccggcctacagcgagaagcgctacgacgagatcgtcaaggaagtcagcgcctacatcaagaagatcggctacaacccggccaccgtgccctttgtgcccatctccggctggcacggtgacaacatgctggagccctcccccaacatgccgtggttcaagggctggaaggtggagcgtaaggagggcaacgcaagcggcgtgtccctgctggaggccctggacaccatcctgccccccacgcgccccacggacaagcccctgcgcctgccgctgcaggacgtgtacaagattggcggcattggcacggtgcccgtgggccgggtggagaccggcatcctgcggccgggcatggtggtgacctttgcgccagtgaacatcaccactgaggtgaagtcagtggagatgcaccacgaggctctgagcgaagctctgcccggcgacaacgtcggcttcaatgtgaagaacgtgtcggtgaaggacatccggcggggcaacgtgtgtggggacagcaagtctgacccgccgcaggaggctgctcagttcacctcccaggtcatcatcctgaaccacccggggcagattagcgccggctactccccggtcatcgactgccacacagcccacatcgcctgcaagtttgcggagctgaaggagaagattgaccggcgctctggcaagaagctggaggacaaccccaagtccctgaagtctggagacgcggccatcgtggagatggtgccgggaaagcccatgtgtgtggagagcttctcccagtacccgcctctcggccgcttcgccgtgcgcgacatgaggcagacggtggccgtaggcgtcatcaagaacgtggagaagaagagcggcggcgccggcaaggtcaccaagtcggcgcagaaggcgcagaaggcgggcaagtgaagcgcgggcgcccgcggcgcgaccctccccggcggtgccgcgctccgaaccccgggcccgggcccccgccccgcccccgccccgcgcgccggtccggcgccccgcacccccgccaggcgcatgtctgcacctccgcttgccagaggccctcggtcagcgactggatgctcgccatcaaggtccagtggaagttcttcaagaggaaaggcgcccccgccccaggcttccgcgcccagcgctcgccacgctcagtgcccgttttaccaataaactgagcgaccccag

SEQ ID NO: 9954 - DNA, 844 bp, Homo sapiens
cgcagttccgccggaagtggccccagcctcgaggccgggcgtcttcggtcatctccggcgcttctagggctggttcccgtcatcttcgggagccgtggagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 9955 - DNA, 880 bp, Homo sapiens
gccggaagtggccccagcctcgaggccgggcgtcttcggtcatctccggcgcttctagggctggttcccgtcatcttcgggagccgtggagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatt

SEQ ID NO: 9956 - DNA, 1098 bp, Homo sapiens
ccccagcctcgaggccgggcgtcttcggtcatctccggcgcttctagggctggttcccgtcatcttcgggagccgtggaggtacgaacttaagacatgcctattttattaatttacttccaaacgcaacgaaaggtccatggacaatttgtgggccatttaattcagggcccccaattcgtacgtggagaagtgggaatgcaaaagtactttgacctttaaccttcggtccggcgcggtggagggaaacgcctccgtctctatataaggaattttccggtctcttcgggtcctttttcctctcttcagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctggatcatggcatttaaataaaagattgaaagatta

SEQ ID NO: 9957 - DNA, 515 bp, Homo sapiens
ccagcctcgaggccgggcgtcttcggtcatctccggcgcttctagggctggttcccgtcatcttcgggagccgtggagcgtggggcgcccacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctgccgatgtggaagacactacaggaagtggagctacagatagtaaagatgatgatgacattgacctctttggatctgatgatgaggaggaaagtgaagaagcaaagaggctaagggaagaacgtcttg

SEQ ID NO: 9958 - DNA, 1179 bp, Homo sapiens
ttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctacagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 9959 - DNA, 2044 bp, Homo sapiens
cttggtcgccgcgtccttggctggcgtgtgtccggaagatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgacggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgggtggcctggtgcctcgaagctgcctccctgtctcaccgacccggtcctcggtctggcctgtccgtgtccagcctgagacccaacagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtgggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 9960 - DNA, 2133 bp, Homo sapiens
ccctttcatcagtcttcccgcgtccgccgattcctcctccttggtcgccgcgtccttggctggcgttagagacagggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgacggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgggtggcctggtgcctcgaagctgcctccctgtctcaccgacccggtcctcggtctggcctgtccgtgtccagcctgagacccaacagaaaaatggctacaaacttcctagcacatgagaagatctggttcgacaagttcaaatatgacgacgcagaaaggagattctacgagcagatgaacgggcctgtggcaggtgcctcccgccagagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 9961 - DNA, 1249 bp, Homo sapiens
cggcgacaccactggccgcgaagcgcagggggggcgcgcgcgctgccgcccgttcccagcacttgtgcagactcctccggggaagagcggcctccgcggtcatctccaacggaattctgcctttgaagtgtcggggcacggcgcgtcgagggtcctggcggccaggcggggcgtgtgcaagggtcgcgtcccccccccgggcccccggcccgtggctcttggtagagcccagtgcttcatttcccgtgcgcggcccgggcggccctccctttcatcagtcttcccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 9962 - DNA, 1452 bp, Homo sapiens
gacaccactggccgcgaagcgcagggggggcgcgcgcgctgccgcccgttcccagcacttgtgcagactcctccggggaagagcggcctccgcggtcatctccaacggaattctgcctttgaagtgtcggggcacggcgcgtcgagggtcctggcggccaggcggggcgtgtgcaagggtcgcgtcccccccccgggcccccggcccgtggctcttggtagagcccagtgcttcatttcccgtgcgcggcccgggcggccctccctttcatcagtcttcccgcgtccgccgattcctcctccttggtcgccgcgtccttggctggcgtaaagctcctcctgagcttggataaactgcaggagcgaaggggctgaccgtttgtcgggacgcagttgaaagagtcgctgtgtcctgctccgggctctcctgctggagaggagaggcttgcacgtgcctgtcgtctgcgcaagctttgaagctcagacttggtctctgttaggagagatgaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggccctctggctccgtcctggtcatttcctgctc

SEQ ID NO: 9963 - DNA, 2350 bp, Homo sapiens
gacaccactggccgcgaagcgcagggggggcgcgcgcgctgccgcccgttcccagcacttgtgcagactcctccggggaagagcggcctccgcggtcatctccaacggaattctgcctttgaagtgtcggggcacggcgcgtcgagggtcctggcggccaggcggggcgtgtgcaagggtcgcgtcccccccccgggcccccggcccgtggctcttggtagagcccagtgcttcatttcccgtgcgcggcccgggcggccctccctttcatcagtcttcccgcgtccgccgattcctcctccttggtcgccgcgtccttggctggcgtgaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgacggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgggtggcctggtgcctcgaagctgcctccctgtctcaccgacccggtcctcggtctggcctgtccgtgtccagcctgagacccaacagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 9964 - DNA, 2207 bp, Homo sapiens
ctccctttcatcagtcttcccgcgtccgccgattcctcctccttggtcgccgcgtccttggctggcgttagagacagggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgacggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgggtggcctggtgcctcgaagctgcctccctgtctcaccgacccggtcctcggtctggcctgtccgtgtccagcctgagacccaacagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 9965 - DNA, 1084 bp, Homo sapiens
ctccctttcatcagtcttcccgcgtccgccgattcctcctccttggtcgccgcgtccttggctggcgtgggatgacggagtgacgtcacctgtgtggactcagctgccacctgggattgtggtggcggcgggtctgtctggcgctcagcttccatctccaccagtgtcacctccacaccacctcgccaagcagcttctggaaaggcccccggccgccccgggctgacctgctgctgtgtctgacccgcagaaaaatggctacaaacttcctagcacatgagaagatctggttcgacaagttcaaatatgacgacgcagaaaggagattctacgagcagatgaacgggcctgtggcaggtgcctcccgccagagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactg

SEQ ID NO: 9966 - DNA, 828 bp, Homo sapiens
gctctgttgtccaggctggagtgcagtggcgccatctcggttcactgcaagctccgcctcccggcttcacgccattctcctgcctcagcctccctaggagctgggactacaggcgcctgccaccacgcccggctaatttttatttttatttttagtagagacagggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtc

SEQ ID NO: 9967 - DNA, 343 bp, Homo sapiens
ctttcatcagtcttcccgcgtccgccgattcctcctccttggtcgccgcgtccttggctggcgtagacagggtttcaacgtgttagccaggatggtctcagtctccagaccctgtgatccgcccgcctcggcctcccaaagtgttgggattacagatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggc

SEQ ID NO: 9968 - DNA, 610 bp, Homo sapiens
ccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgggtggcctggtgcctcgaagctgcctccctgtctcaccgacccggtcctcggtctggcctgtccgtgtccagcctgagacccaagtaggagaaacgtgctgggtgggcacccagcctgggctgtgggcacagggacagccatcccaggctggggctcctccagcttcctcccctgcccacctggggtgggggctccccgagacccgtgggcccagcagagttgaatgcaggagcaggctgagtaaagaaaaatggctacaaacttcctagcacatgagaagatctggttcgacaagttcaaatatgacgacgcagaaaggagattctacgagcagatgaacgggcctgtggcaggtgcctcccgccag

SEQ ID NO: 9969 - DNA, 559 bp, Homo sapiens
ctccctttcatcagtcttcccgcgtccgccgattcctcctccttggtcgccgcgtccttggctggcgtgggatgacggagtgacgtcacctgtgtggactcagctgccacctgggattgtggtggcggcgggtctgtctggcgctcagcttccatctccaccagtgtcacctccacaccacctcgccaagcagcttctggaaaggcccccggccgccccgggctgacctgctgctgtgtctgacccggttagtctttctggctgcctctaaccttgctgcttttccttcatgctgtcctaggaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcagga

SEQ ID NO: 9970 - DNA, 367 bp, Homo sapiens
gggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctagtgagcacggaaaggaataagcctatgaggagcgggaaggcctcctgcaccctggagaccgtgtgggaagacaagcacaagtatgaggaggccgagcggcgcttctacgaacacgaggccacacaggcggccgc

SEQ ID NO: 9971 - DNA, 535 bp, Homo sapiens
gggatgacggagtgacgtcacctgtgtggactcagctgccacctgggattgtggtggcggcgggtctgtctggcgctcagcttccatctccaccagtgtcacctccacaccacctcgccaagcagcttctggaaaggcccccggccgccccgggctgacctgctgctgtgtctgacccggttagtctttctggctgcctctaaccttgctgcttttccttcatgctgtcctaggaggccaaagcaaaagacagggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggcc

SEQ ID NO: 9972 - DNA, 770 bp, Homo sapiens
cgtccgccgattcctcctccttggtcgccgcgtccttggctggcgtatgtgtggagacctccaggccgtgcagcaccttggtggccacagctctccaggatgtcctcaccttcctcagggccctgccctcctgacctggagtgttctggaaagctcctcctgagcttggataaactgcaggagcgaaggggctgaccgtttgtcgggacgcagttgaaagagtcgctgtgtcctgctccgggctctcctgctggagaggagaggcttgcacgtgcctgtcgtctgcgcaagctttgaagctcagacttggtctctgttaggagagatggtgcgctgcgtccggcagggcctgcctaggctccaactgacagtaatcccaagagctcccctttcaggggatgacggagtgacgtcacctgtgtggactcagctgccacctgggattgtggtggcggcgggtctgtctggcgctcagcttccatctccaccagtgtcacctccacaccacctcgccaagcagcttctggaaaggcccccggccgccccgggctgacctgctgctgtgtctgacccgcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctgga

SEQ ID NO: 9973 - DNA, 996 bp, Homo sapiens
catttcccgtgcgcggcccgggcggccctccctttcatcagtcttcccgcgtccgccgattcctcctccttggtcgccgcgtccttggctggcgtatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgacggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctg

SEQ ID NO: 9974 - DNA, 558 bp, Homo sapiens
ctccctttcatcagtcttcccgcgtccgccgattcctcctccttggtcgccgcgtccttggctggcgtaaagctcctcctgagcttggataaactgcaggagcgaaggggctgaccgtttgtcgggacgcagttgaaagagtcgctgtgtcctgctccgggctctcctgctggagaggagaggcttgcacgtgcctgtcgtctgcgcaagctttgaagctcagacttggtctctgttaggagagatggggatgacggagtgacgtcacctgtgtggactcagctgccacctgggattgtggtggcggcgggtctgtctggcgctcagcttccatctccaccagtgtcacctccacaccacctcgccaagcagcttctggaaaggcccccggccgccccgggctgacctgctgctgtgtctgacccggttagtctttctggctgcctctaaccttgctgcttttccttcatgctgtcctaggaggccaaagcaaaatgaggagcgggaaggcctcctgcaccctggagaccgtgtgggaagacaagcacaagtatgagg

SEQ ID NO: 9975 - DNA, 553 bp, Homo sapiens
acaatgccctgtctcctgggctcttgctcccaccccacccccaacccacaacccctgcctctgcccatcagcctggccttgatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccacc

SEQ ID NO: 9976 - DNA, 923 bp, Homo sapiens
ccgggcggccctccctttcatcagtcttcccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccagagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 9977 - DNA, 1311 bp, Homo sapiens
cgcgcctgcgcgctggccgcctcgtgcgtcactcggcgcttgccggctgccggacccgcccccaccggcgacaccactggccgcgaagcgcagggggggcgcgcgcgctgccgcccgttcccagcacttgtgcagactcctccggggaagagcggcctccgcggtcatctccaacggaattctgcctttgaagtgtcggggcacggcgcgtcgagggtcctggcggccaggcggggcgtgtgcaagggtcgcgtcccccccccgggcccccggcccgtggctcttggtagagcccagtgcttcatttcccgtgcgcggcccgggcggccctccctttcatcagtcttcccgcgtccgccgattcctcctccttggtcgccgcgtccttggctggcgtaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 9978 - DNA, 600 bp, Homo sapiens
ctccctttcatcagtcttcccgcgtccgccgattcctcctccttggtcgccgcgtccttggctggcgttagagacagggtttcaacgtgttagccaggatggtctcagtctccagaccctgtgatccgcccgcctcggcctcccaaagtgttgggattacagatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggt

SEQ ID NO: 9979 - DNA, 853 bp, Homo sapiens
gtcttcccgcgtccgccgattcctcctccttggtcgccgcgtccttggctggcgtaaagctcctcctgagcttggataaactgcaggagcgaaggggctgaccgtttgtcgggacgcagttgaaagagtcgctgtgtcctgctccgggctctcctgctggagaggagaggcttgcacgtgcctgtcgtctgcgcaagctttgaagctcagacttggtctctgttaggagagatgcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagcct

SEQ ID NO: 9980 - DNA, 583 bp, Homo sapiens
ctccctttcatcagtcttcccgcgtccgccgattcctcctccttggtcgccgcgtccttggctggcgtagacagggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctg

SEQ ID NO: 9981 - DNA, 1217 bp, Homo sapiens
ctgagatcaggagttcaagaccagcctggccaacatggtgaaaccttgtctactaaaaatacaaaaaattagccaggcacagtggtgtgcactggtagtcccagttactcgggaggctgaggcaggaaaatcgcttgaacccaggaggcggacgttgcggtgagccgagatcgcgccgctgattccagcctgggcgacaagagtgagactccatctcacacaaaaaaaaaataacaaaaaaactcagaaatgctaagtgtacttatttgttgaagaaacttgttacatattactaacatcttttttttttatgagaaatacttttcccataaccaaaaaattcagtgagcagaatggccttgcttgaggtttttgcaaatctctcgggtgtctggcttagtgggaggcagctgggccctcatacctgcctccgcacttcagctgtttgacataaacccagcttcgtgtgagtgaaagggaagggcctggggaccctcagaggttctcggaccacactttgagaactcctcgtctggaagacaggcctggggatgccatgtggggtgagggcttacgggcttggtgtcgctttgtggagaaccgctggtgtctgaagcgggtgtcagccccactgcaccttggtgcttctgggctgtcctgatgccgaggcccacttcccagccatgctgactttgcctctttcccctcccagcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggag

SEQ ID NO: 9982 - DNA, 616 bp, Homo sapiens
ctccctttcatcagtcttcccgcgtccgccgattcctcctccttggtcgccgcgtccttggctggcgtggcctgcctaggctccaactgacagtaatcccaagagctcccctttcaggggatgacggagtgacgtcacctgtgtggactcagctgccacctgggattgtggtggcggcgggtctgtctggcgctcagcttccatctccaccagtgtcacctccacaccacctcgccaagcagcttctggaaaggcccccggccgccccgggctgacctgctgctgtgtctgacccggttagtctttctggctgcctctaaccttgctgcttttccttcatgctgtcctaggaggccaaagcaaaatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctg

SEQ ID NO: 9983 - DNA, 787 bp, Homo sapiens
ctcctccttggtcgccgcgtccttggctggcgttgtcacctccacaccacctcgccaagcagcttctggaaaggcccccggccgccccgggctgacctgctgctgtgtctgacccggttagtctttctggctgcctctaaccttgctgcttttccttcatgctgtcctaggaggccaaagcaaacagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcct

SEQ ID NO: 9984 - DNA, 813 bp, Homo sapiens
ttgctcccgggttgctgggtgaggctgcaaggtttagcacagatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgacggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccaggg

SEQ ID NO: 9985 - DNA, 926 bp, Homo sapiens
caccttcgccttctcaccacatgcctcaggcccagccaggctcctagacctgcctctgtagaggctttctgggcgcagtgccaatcctgtgagacagcagcatctcccctgggctgctgcagggttcacacgcagtcagtgctggcagagtgagcgcccagccgacagagcccccgctgcctcccgcctcctctggaggactaggccctctgggctttgctcccgggttgctgggtgaggctgcaaggtttagcacagtagagacagggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggag

SEQ ID NO: 9986 - DNA, 614 bp, Homo sapiens
ccctttcatcagtcttcccgcgtccgccgattcctcctccttggtcgccgcgtccttggctggcgtgtgagtaccgcggcccccgccggaaggagtcgggcgcgacagagacgcccgaggggccgggagggcgggcggcccgggctgcgccagaagctcgcgccgttagggactgaggcacaagtgcgccagcgcgggcttaggggccgtgggccaagtgcggcacttggggcgagcgcagagaggcggggcgacggaggccacgtggccggcttggagggcgtccgcgggacgggggcgccgggagcactgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggatagcagaaaaatggctacaaacttcctagcacatgagaagatctggttcgacaagttcaaatatgacgacgcagaaaggagattctacgagcagatgaacgggcctgtggcaggtg

SEQ ID NO: 9987 - DNA, 506 bp, Homo sapiens
actgtctcacggcgcatcccggtcgtggaagcccctcggccaggctgctggggcctaaggcctgtgtttgctgccgtctccgtgggagaccagacatctgccccagctgtttctctggcctgcagaccttcgtacaccacgtctttgtcaagcaccagttactgcacgcatcagctgagcacggaggggataggcacggacgcaacacttttggaacttagacgctatagagacagggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatga

SEQ ID NO: 9988 - DNA, 791 bp, Homo sapiens
cagaggctttaagtggaaggaagaaggcaaagggggcggagtgggttggggacctgatgagacgtcaggattggtttccagaatgaaggaccgcctggcagcagaagaactgtgtagctaaacttggggttgtccctgcccgacagggcggggtgcttcttaagttgacactgcctgcggctcacctcccagggaggcaggccaggccatctcacctgagcagcctccttctacagctccgcccaccccgtcatctggaccccatgagccttaagcagctggctcgcaggcagttggttacttccggagcccgtgtgtgcccagccccgttctgggggtgggggatgcagctgaggggctgggcaggtgtggaaggagcccccgagcgtcctctgaggaagtagacgctcaccttcgccttctcaccacatgcctcaggcccagccaggctcctagacctgcctctgtagaggctttctgggcgcagtgccaatcctgtgagacagcagcatctcccctgggctgctgcagggttcacacgcagtcagtgctggcagagtgagcgcccagccgacagagcccccgctgcctcccgcctcctctggaggactaggccctctgggctttgctcccgggttgctgggtgaggctgcaaggtttagcacagcagaaaaatggctacaaacttcctagcacatgagaagatctggttcgacaagttcaaatatgacgacgcagaaaggagattctacgagcagatgaacgggcctgtggcaggtgcctcccgccag

SEQ ID NO: 9989 - DNA, 761 bp, Homo sapiens
ctccctttcatcagtcttcccgcgtccgccgattcctcctccttggtcgccgcgtccttggctggcgtggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgacggca

SEQ ID NO: 9990 - DNA, 2387 bp, Homo sapiens
taaagcttatttcagataaatgacgaaaaatttttagtgtaagtatgtctcagatacttcatgggccatacattcactaacaaaattatatattgttcatgtattgggaggcacttggcctcccagagtactgagattacaggcatgagccactgcgcccggcctgttttctcttcacaacaaaacgtccccacatgggcttgacttcgaagtcctcgaatgtcatctcatggaagccccactggggagcatcctcagcccctgcccagggagggcagccacggggagggcgggcacggggagggtgggcacggggctgcggccacccgctgtgttgcaactctgccctctgcttgctttttatcgctgtgtccggaagatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcggcagcaggcgtgatcccaggaagagccaggacagcaggaagcccctgcagaaaaagaggaagcgctcccccaagagcgggctcggccccgcggacctggccctcctgggcctctcggccgaacgcgtgtggctggacaagtcacttttcgaccaggcagagagctcctaccgccagaagctggcagatgtggctgcccaggcagcctggcctcctgccttggccccttggggtctctgcacccatggaaaccaggtggcctgccaccacgtgacctgggggatctgggtcaacaagtcctccttcgaccaggctgagcgggccttcgtggagtggtctcaggccctgttgctggcccccgacggcagccgcaggcaggggactcccaacacaggccagcaggtggccgtccccgacctggcccaccagcccagcccaccggtcaatggccagcccccgctgggcagcctgcaggcactggttcgggaggtgtggctggagaagccccggtatgatgcagccgagaggggcttctacgaggccctgtttgacggccatcccccagggaaggtgcgcctgcaagagcgagccggcctggccgagggtgcccggcggggccgcagagaccggcggggccgcaacatcttagggaacaagcgggccgggctgcgacgggccgatggggaggccccctctgccttgccctactgttacttcctgcagaaggatgcagaggccccctggctcagcaagcctgcctacgacagcgccgagtgccgccaccacgctgccgaggccctgcgggtggcctggtgcctcgaagctgcctccctgtctcaccgacccggtcctcggtctggcctgtccgtgtccagcctgagacccaacagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 9991 - DNA, 842 bp, Homo sapiens
gcgtccgccgattcctcctccttggtcgccgcgtccttggctggcgtaaagctcctcctgagcttggataaactgcaggagcgaaggggctgaccgtttgtcgggacgcagttgaaagagtcgctgtgtcctgctccgggctctcctgctggagaggagaggcttgcacgtgcctgtcgtctgcgcaagctttgaagctcagacttggtctctgttaggagagatgaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagcct

SEQ ID NO: 9992 - DNA, 758 bp, Homo sapiens
cgcgtccttggctggcgtggcctgcctaggctccaactgacagtaatcccaagagctcccctttcaggggatgacggagtgacgtcacctgtgtggactcagctgccacctgggattgtggtggcggcgggtctgtctggcgctcagcttccatctccaccagtgtcacctccacaccacctcgccaagcagcttctggaaaggcccccggccgccccgggctgacctgctgctgtgtctgacccgcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggaca

SEQ ID NO: 9993 - DNA, 1001 bp, Homo sapiens
gtccttggctggcgtaaagctcctcctgagcttggataaactgcaggagcgaaggggctgaccgtttgtcgggacgcagttgaaagagtcgctgtgtcctgctccgggctctcctgctggagaggagaggcttgcacgtgcctgtcgtctgcgcaagctttgaagctcagacttggtctctgttaggagagatggtgcgctgcgtccggcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggagga

SEQ ID NO: 9994 - DNA, 538 bp, Homo sapiens
ccctttcatcagtcttcccgcgtccgccgattcctcctccttggtcgccgcgtccttggctggcgtgggatgacggagtgacgtcacctgtgtggactcagctgccacctgggattgtggtggcggcgggtctgtctggcgctcagcttccatctccaccagtgtcacctccacaccacctcgccaagcagcttctggaaaggcccccggccgccccgggctgacctgctgctgtgtctgacccggttagtctttctggctgcctctaaccttgctgcttttccttcatgctgtcctaggaggccaaagcaaatagagacagggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgagg

SEQ ID NO: 9995 - DNA, 555 bp, Homo sapiens
ctccctttcatcagtcttcccgcgtccgccgattcctcctccttggtcgccgcgtccttggctggcgttgtcacctccacaccacctcgccaagcagcttctggaaaggcccccggccgccccgggctgacctgctgctgtgtctgacccggttagtctttctggctgcctctaaccttgctgcttttccttcatgctgtcctaggaggccaaagcaaatagagacagggtttcaacgtgttagccaggatggtctcagtctccagaccctgtgatccgcccgcctcggcctcccaaagtgttgggattacaggtgtgagccaccgtgcctggccgaggctccttcttttatgaggagcgggaaggcctcctgcaccctggagaccgtgtgggaagacaagcacaagtatgaggaggccgagcggcgcttctacgaacacgaggccacacaggcggccgcctccgcccagcagctgccagccgaggggccagccatgaatgggcccggccaggacgaccctgaggacgctgatgaggcggaagcccctgacggcg

SEQ ID NO: 9996 - DNA, 926 bp, Homo sapiens
ccctttcatcagtcttcccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtggcaggtgcctcccgccaggagaacggcgccagcgtgatcctccgtgacattgcgagagccagagagaacatccagaaatccctggctggaagctcaggccccggggcctccagcggcaccagcggagaccacgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgaggccctgccacgattaaagactgagaccggc

SEQ ID NO: 9997 - DNA, 1077 bp, Homo sapiens
aatgcgggaggttcttgttctgcaggtctcgcgtctgccaggagctacggccggaagatggcggcggccgcagagttgtcgctactggagaagtccctgggactgagtaaggggaataaatacagtgctcagggcgagcgacagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttatagttgacctgacagttcaagaaaaggagaaatatcttaatgtgtctcgctggttttgtcacattcagcattatccaggcatcaggcaacatctgtctagtgttgtcttcatcaagaacagactatatactaattcccactagaagctgtccatgccatacagaagatctattaaaaatgttttaaatggaaaatgtactctagaccacaggactaatgtaaattaatatacagtcattcattatttgttgaagttgatagaatttttgaagtgtaaacttgtgtctgaatgttttatttgttctttagctgaagttttgcaatttttatgtcaaaattcaattgctattaaacaagttgagatccagttataaattaaccttgtttttagtagatgacatttatttcaataaaagttgcaaatcgggcttaatcttaaaattggtggtcatttcaatggttgacatatttggctatttattaacctctctttcatattctaaaattcattttccccttatggatatttatggtagtttgttaagaactgataaattgtgccaaggaagccaaaagggaagacagatggatttgttttaaaatatttatgtgagctagtaaatgtggttgaaaaaata

SEQ ID NO: 9998 - DNA, 562 bp, Homo sapiens
gcgtctgccaggagctacggccggaagatggcggcggccgcagagttgtcgctactggagaagtccctgggactgagtaaggggaataaatacagtgctcagggcgagcgacagattccagttcttcagacaaacaatggtccaagtctaacaggattgactactatagcagctcatctagtcaagcaagccaacaaagaatatttgctggggagtactgcagaagaaaaagcaatcgttcagcagtggttagaatacagggtcactcaagtagatgggcactccagtaaaaatgacatccacacactgttgaaggatcttaattcatatcttgaagataaagtctaccttacagggtataactttacattagcagatatactattgtactatggacttcatcgctttataataaggaagctgaggcacacagaggtagggaactaacccaacatcatacaaggaactgagatcaaggaactgagattcaaacacaaatgtctggctcaaacttacctgtaaactactctacatggagtgccataaaattctgcttaattaa

SEQ ID NO: 9999 - DNA, 1523 bp, Homo sapiens
gtcttctgtttcgtcctcgctttccggctgctgtttctccacggctctcctctttccccctcccttctctcccgggcggcttactttgcggcagcgccgagaaccccaccccctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttgggcatcatgcaccacaacaaacaggccactgagaatgcaaaggaggaagtgaggcgaattctggggctgctggatgcttacttgaagacgaggacttttctggtgggcgaacgagtgacattggctgacatcacagttgtctgcaccctgttgtggctctataagcaggttctagagccttctttccgccaggcctttcccaataccaaccgctggttcctcacctgcattaaccagccccagttccgggctgtcttgggcgaagtgaaactgtgtgagaagatggcccagtttgatgctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacattgaa

SEQ ID NO: 10000 - DNA, 1631 bp, Homo sapiens
accagcttctccttcctacagttcgcacagctcgaggggagtgcgggggcagcaccgcgcgtggcacctggcacccgcgcagagttcctgaatggcagagcggtgggtggctccagcagtactgagaagagccaggtttgcctccacattcttcctgtcgcctcagatttatgcgcacaaggacggagatttgcgttcagcgttcttcattctctcctttaaacgaggagagttcatcccgttcttaaactggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgcaaatttcctgccggcaaggtcccagcatttgagggtgatgatggattctgtgtgtttgagagcaacgccattgcctactatgtgagcaatgaggagctgcggggaagtactccagaggcagcagcccaggtggtgcagtgggtgagctttgctgattccgatatagtgcccccagccagtacctgggtgttccccaccttgggcatcatgcaccacaacaaacaggccactgagaatgcaaaggaggaagtgaggcgaattctggggctgctggatgcttacttgaagacgaggacttttctggtgggcgaacgagtgacattggctgacatcacagttgtctgcaccctgttgtggctctataagcaggttctagagccttctttccgccaggcctttcccaataccaaccgctggttcctcacctgcattaaccagccccagttccgggctgtcttgggcgaagtgaaactgtgtgagaagatggcccagtttgatgctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacattg

SEQ ID NO: 10001 - DNA, 1008 bp, Homo sapiens
ctttctttgcggaatcaccatggcggctgggaccctgtacacgtatcctgaaaactggagggccttcaaggctctcatcgctgctcagtacagcggggctcaggtccgcgtgctctccgcaccaccccacttccattttggccaaaccaaccgcacccctgaatttctccgccattgcctactatgtgagcaatgaggagctgcggggaagtactccagaggcagcagcccaggtggtgcagtgggtgagctttgctgattccgatatagtgcccccagccagtacctgggtgttccccaccttgggcatcatgcaccacaacaaacaggccactgagaatgcaaaggaggaagtgaggcgaattctggggctgctggatgcttacttgaagacgaggacttttctggtgggcgaacgagtgacattggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacattg

SEQ ID NO: 10002 - DNA, 3157 bp, Homo sapiens
ctcttccgccgtcgtcgccgccatcctcggcgcgactcgcttctttcggttctacctgggagaatccaccgccatccgccaccatggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaactggacagcgaggacaaggacaaagaaggcaaacccctgctgaaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcatatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctatgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtg

SEQ ID NO: 10003 - DNA, 1832 bp, Homo sapiens
ctcttccgccgtcgtcgccgccatcctcggcgcgactcgcttctttcggttctacctgggagaatccaccgccatccgccaccatggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaactggacagcgaggacaaggacaaagaaggcaaacccctgctgaaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcatatcatcgcgggcgccggcgagctgcacctggagatctgcctgaaggacctggaggaggaccacgcctgcatccccatcaagaaggagactgtctcaaaaaaaaaaaaaaaaaaaaaa

SEQ ID NO: 10004 - DNA, 765 bp, Homo sapiens
cgccgagcgtggacgcaggcggatctctgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaagagtatgctcaggtaatcaaaatgttgggaaatggacggctagaagcaatgtgtttcgatggtgtaaagaggttatgtcacatcagaggaaaattgagaaaaaaggtttggataaatacctcggacattattttggttggtctccgagactaccaggataacaaagctgatgtaattttaaaatacaatgcagacgaagctagaagtctgaaggcatacggcgagcttccagagcatgctaaaatcaatgaaactgatacatttggtcctggagatgatgatgaaattcagtttgatgacattggagatgatgatgaagatattgatgacatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatggg

SEQ ID NO: 10005 - DNA, 4427 bp, Homo sapiens
cgcggcgccatttgctgccgccgagcgtggacgcaggcggatctctgaagagctgggtcgccagcctctcccgcgcacgttgcctggcctccagcacctacttggtcccgcgcgctccctcgtgtcgcccctcggagcagcagccgccgcggtcgccgctacccggaaagaagtcagagacgccgcgaggtcgccgccaccgccatgcccaagaataaaggtaaaggaggtaaaaacagacgcaggggtaagaatgagaatgaatctgaaaaaagagaactggtattcaaagaggatggtcaggagtatgctcaggtaatcaaaatgttgggaaatggacggctagaagcaatgtgtttcgatggtgtaaagaggttatgtcacatcagaggaaaattgagaaaaaaggtttggataaatacctcggacattattttggttggtctccgagactaccaggataacaaagctgatgtaattttaaaatacaatgcagacgaagctagaagtctgaaggcatacggcgagcttccagagcatgctaaaatcaatgaaactgatacatttggtcctggagatgatgatgaaattcagtttgatgacattggagatgatgatgaagatattgatgacatctaaattgaactcaacattttacattccatcttttctgaagattgtcctacaatttggattttgatcatgacaaagaagattaaaatttcattagcatgaatgcaatttgttaaagcagactgatttgtttctaagatatttttggtttttttaaaactgataataatgctgaattatcttaagtgagatgttaagcccactttgttcttttaatgtaatggagcttatgggtagaagaccatgtctactaattacaaaaaaaaaaaaaaaccatgcattgctgcttttcctaccacttccagtaagaaaatgggtgttttgaagaaatcatttgccttgtcctcacggaatctgattaagccctggcctcttgattgtatagagtcattgtgtatattccagttacctagatattcccttgagattttgatacaatttgagggaggcagaagtctgcagttgaagaaaaaaaataagtctgtttgtcatatttaagtagcctgtggctatttttatactgattttgatatcatgttcttttcatagtcgtattttgccaccgtaaacataaaaaaaaaaaaaaagatttccaaaatgccgttttcagaacctgggttttaatagcagtattgaatttgtaagcttagtagttgcagaaattgaacactaggtggcactcagttatcttaacaggggaagtactgatacaattgttgacttttcttttactatgtgtaagaaataccccaaacatgaaaagattgttttgatcatatgcatgtatgtagaatatttttgcagagcagaaagattatgttagaagtgtgatttttattttcagaagtcatatacatgtaagctacaattttgagtgctttataaacacttaagatatatatataaattttaatttcatagcaacttgtaaaaaataaaatacttgttgaaaagcctttttcaacatatccctaagctaagggaagaggaaggaataacaactcagtgaaaagatggtctccagtttctgaatgaaaaagctacagctgagaaataaaataaaatgtcatgctgcagaatatgttatacccttattttgtgttaaggatatattttattatgtgaatggttttgtttttgttttttgtttttgttttttgcttgtattgggaattagctttactggtaacttccttatttagtttttagtggtcaactctaataaaatgaaactagggctgagctagttagccctcactagccaaactgaaactctatgcaacattaaaagaagagatccatcatgtagcttgtgacacttttattttattagtcaccggggaacttttcagtgatgaaaatacacagggtaataaaccttcacatggcttcaaaaggaaaacaagcaaatcttctctaatctactcttactataatttcctaagtgtacaccaaactctggatttaaaaatctgaagtactatagaacattaagttgaagaatggaaattaagagtacgtattcatggtttatatttcttattctatggagttcgtgaacacatctaggtggaatgcatctgagactaagggctggtttttaatcctcataagaaaccagccttgaagaattaacaattctcttcattggtattctaaacctcctaagatatttaggcttctgtacataaaagtgtttttgctaaatttacagtatatatagatcctttcatattattttactaagaatgtttgaactttgcatatttgatatagttcctggtaggaatagcacagctcaaacattagtttttctacttacctcctctaacacgtggtttgtctggagagtttctaaaaattcagctataaccccagttcatgtatttactggtgattgttcttgctgaggtagtaacagcccaatcttgggctgttaaatcctaggaaatctcgaatcatagtgattaaaatagttggggtaaagttgtagcttatatgcaatactacttggaggaattcttctactaatttgtatttaatgtggaaattgtatagtttcattgatttaatcataaataatggaaatggtctccaagaagttttatttttcatttttttgcttatacactctgattcctataatacagtgctataagctatgcacagaaaataaaatgtttgaaatccaagaataatggttcttactgctaagagggagtaatagttattactaatgattttgattgggttgcatttttgttgcaatgtttattccacttgcagttagaatatgaatatgttttatcactagtgtggctaaataaccaaacatttgtgtaaaaaaaaaaaaaagccaagatttcattgtttgttgaatatttcttaagcatctggcccctaaagagaccgcttcttaccaagcctgtaaactatgcatgatggaaattcttgtattttatttaggaatggctgttggtttactcaccacatctgtggaatcatggctataaatgtttgcttacaaactctttgtgacttgtaatttaacttaatctcatctaatgtaaatattagattatgatgttcagtaacatcttccataggtataaactgctgtcattattgatttcagagtaactctgagtaatcaaataggtaaaagcatgttttgagtaaaatagctagatttatactttacttgtatacagacttaacaacaaccggtattgactggattgacagctaaagtatcagaatgaaagcaaggtttttttgatgttacctgactgtcataaagatgaaaatgatttgtattggtatgaaatgcttatctttattctacttcgtaagggtaagttttatttatactctttggactcccatgaacttttgcacactgctttgtgtttttggtttaccctaaactaccatcctttttatctttgctttttttcttcctattcagaaaagagcaaaatgtgaaaagacacaagactctcaggtatagaatgaactgagcaatttggagaatgtattggactttgtcctctcttattcccccctcctagccctgcaagttgctaggtacttgtgaggcagtgtactggagaggggagagcatggatcctggggtcaaagggcctttgcccccacccttacttggccctctacctgcaggtgaccactggcacattctcctgcttgtctcagcttcaggttcttcacctctaagatggggatgatgaaaacagtacctgtcatgcagaattgttgggaggattgataatttagatgtttatacatgtaatgtacttagatcagtgtctgctcttttcacttgatatccagtactatgtaagatagaaggtgcatgtcttctgtattctgtatttcccatttcttttgcgtgcagtctttgattcgtacaatagaaggaacacgtagaatgtatatttgtacattcatgtcaacatagtatttgaaattgctaccaaactcatttaatttggcataagactaacagatgaagtctctcatttgcttgaagatattttacaaaataccaactgttctatatttctttagaaaaagattatagttattaatattgatacctctgataatattttattcttaaatcttcagtgattccttttactatagattcatgacagctaattagtactaactgatttagaggtttcctttcccatcatatggaatgatgtaaagaaatcagatacaaactactgcaattagaaaataaaatatgaacaactttcaacaatgta

SEQ ID NO: 10006 - DNA, 1390 bp, Homo sapiens
agagagtgcgcgtcagcagtttattagagagctctgtagccagcctcttctgcgcacccacctgctgcatcttagttcagtcggctcttagagtagtaaccgccagaaaggagtcggaagaggtctcacgaggctgtcatcaccgccatgcccaagaataaaggtaaaggaggtaaaaacaggcgcaggggtaaaaatgagaatgaatctgaaaaaagagagttggtgtttaaagaggatggacaagagtatgctcaggtaatcaaaatgttgggaaatggacgattggaagcattgtgttttgatggtgtaaagaggttatgccatatcagagggaaattgagaaaaaaggtttggataaatacatcagacattatattggttggtctacgggactatcaggataacaaagctgatgtaattttaaagtacaatgcagatgaagctagaagcctgaaggcatatggcgagcttccagaacatgctaaaatcaatgaaacagacacatttggtcctggagatgatgatgaaatccagtttgacgatattggagatgatgatgaagacattgatgatatctaaattgaaccaagtgtttttacatgacaagttctctgaggatggttctacagttgggattttggccatcatcaaccaagaagagaaattcatttagtgtgtagtttctgaaagcaaactgatttattttcattgttttaaagtatttatttctttaaaagctgaggacactgaattaccttaagttaaatgttaatactttattgttttgatgtaatggaacttaaggataaaagaccataatatttgctgttaaaataaataaacgagtgcctttcctactgtgataacgtcaagtaattggatattttgaatacatttctgcctgataatcatgctgggttctaataagccctacttccacctaatctgtttacagtcttttggtatgtttcagttacttagatggtctcataaggtttctgatacaatttgaagacagaaatctgcatttagaatcagaaaacatggacatatttttcatatttatctagtcatatgtaattttatgctaacattgatagtttataaatccttttcatcctttgtgcctcggttattaaggaaaaaaaaatgtccaacatacagtttttaaagtgtggcagttttgagtagtaacttagaatgtataagattaagagttaaagaaaccgaacaataagtggcaaccaattatcttaacattggaaatactggggtgccattttgttttcaaaagttattcattgtaatccactgttttggctttcatgaacaagtaaattacagtgtataaatgaaaagcaatttcataataaattctataaactga

SEQ ID NO: 10007 - DNA, 746 bp, Homo sapiens
tcttagttcagtcggctcttagagtagtaaccgccagaaaggagtcggaagaggtctcacgaggctgtcatcaccgccatgcccaagaataaaggtaaaggaggtaaaaacaggcgcaggggtaaaaatgagaatgaatctgaaaaaagagagttggtgtttaaagaggatggacaagagtatgctcaggtaatcaaaatgttgggaaatggacgattggaagcattgtgttttgatggtgtaaagaggttatgccatatcagagggaaattgagaaaaaaggataacaaagctgatgtaattttaaagtacaatgcagatgaagctagaagcctgaaggcatatggcgagcttccagaacatgctaaaatcaatgaaacagacacatttggtcctggagatgatgatgaaatccagtttgacgatattggagatgatgatgaagacattgatgatatctaaattgaaccaagtgtttttacatgacaagttctctgaggatggttctacagttgggattttggccatcatcaaccaagaagagaaattcatttagtgtgtagtttctgaaagcaaactgatttattttcattgttttaaagtatttatttctttaaaagctgaggacactgaattaccttaagttaaatgttaatactttattgttttgatgtaatggaacttaaggataaaagaccataatatttgctgttaaaataaataaacgagtgcctttcctactgtga

SEQ ID NO: 10008 - DNA, 2858 bp, Homo sapiens
agtattgcctgcacaaatatctaccaggtctgcgacgaatagctccagcaacttcgcaccgtgttttccactcagcctaccgacaggcactgtgcagattcaagcggagagatgtccaagcagtgaggccgctgctgcaccggccatcctgagcccctactcggccttcccgtctccgcttccccgccccgcactaggacccctgcagatgatcaggcggcagccggggtgatttccttcctcttttggcaacatggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgatagctggtaatgaatcttgccctcagcctcagacatcggaacacctggctgctatagagatcatgaaactgaagcatattttgattctacaaaataaaattgatttggtaaaagaaagtcaggctaaagaacaatacgagcagatccttgcatttgtccaaggtacagtagcagagggagctcccattattccaatttcagctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagatagaagtaagacctggtattgtttccaaagatagtgaaggaaaactcatgtgtaaaccaatcttttccaaaattgtatcactttttgcggagcataatgatctgcaatatgctgctccaggcggtcttattggagttggaacaaaaattgaccccactttgtgccgggctgacagaatggtggggcaagtacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcaacaggagggagagttagtgctgtcaaggccgatttgggtaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccagttaaataatacattcggatggatttggaagttggaattcctcttaacaaccaaggggtttattttcaaagcaatattggggaattgatttcacagttcgttaccttagtaggtaacggtaaggttattctctttttttttttttttttttttggttatgaaaacttagggactaaaattaatataaaaattggcataatgttggattgaatctacattttggcagaagttaaacattcccacataatgtcaaaattatacatcatgcagttctgtttttttgtttgttttattttgttttgtttttgagtctggctctgtcacccaggctggagtgcagtggcgtgatctgcaacctctgccccccgggttcaagcgattctcctgcctcagcctcccgagtagctgagattacaggtgcgcgccaccacacttggctaatttttgtattattagtagagacggggtttcagcatgttggctaggccggtctctcctgacctcagggtgatcagcccacctcggcctcacaaagtgctgggattacaggcgtgagccaccttgcccagcccacatcatacagtttgaaatgaaactttgccacaaccagcctttgctgtagcacacacatatatcactgaacctgtttgaaataaagttttttttctttttcatgattcgtctttgagtacctccaggctgaaagactgttgtaccagtaaaaacttaaaggcacaaattctccttgaagaccttctcccttttatgtggccccatattttatgttgctttatctttgaaattttgcatgaaaaggaaatgaatggattcgaatgaaattgtcctttagagcatgattacttgttcccatggacaaatatttttctccccttgctcttcctggcctgaaacacgggaaaccagagtcaaaagttatctccctctccctgtgatgccttgagatttttttctgcgttgtttaatgcctgaaatccaagtcttcctccatgggaaaatactgttataccaaataattctagatgagtaacaaagatctttttaggccttcattttatgttttttcttaactgttatattatgattgtgacatagattatactactactaatttttggatgtttcaaaaggtcaagaagtaaaagatgttagaaagcaa

SEQ ID NO: 10009 - DNA, 773 bp, Homo sapiens
ggcgggcggagaagctggagtgactctagggcagccgcatctttcgcgtcaggatctcaccaccttggatgttaccaagttgacgccactttcacacgaagttatcagcagacaagccacaattaacataggtacaattggtcatgtagctcatgggaaatccacagtcgtcaaagctatttctggagttcatactgtcaggttcaaaaatgaactagaaagaaatattacaatcaagcttggatatgctaatgctaagatttataagcttgatgacccaagttgccctcggccagaatgttatagatcttgtgggagcagtacacctgacgagtttcctacggacattccagggaccaaagggaacttcaaattagtcagacatgtttcctttgttgactgtcctggccacgatattttgatggctactatgctgaacggtgcagcagtgatggatgcagctcttctgttgataggtaaatacctcacaattggtttggacaaatcaatgtggaacaaatccaagatgaaatatttaaaggggaactaaggcctttaaggatcatatctattacctaagggtgacatgaatgggaactaacatgtcatccaggatgactttcctacctatcagctatcacaaaatactcaaaaagatagacttggggctgatagcttgcgagaattcttgtggtagcatttgagaaaaagaaaaaaagtcaatagttcatttttctcatttaaatcacatgaggtgatttatttagttttaa

SEQ ID NO: 10010 - DNA, 1445 bp, Homo sapiens
atgttccaggaagtaaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaacaaagacattttaaattt

SEQ ID NO: 10011 - DNA, 2198 bp, Homo sapiens
gatggctccggaaacaccaattcgctgtctccacgcatgaggagacgtgtaggggccgggttcggccctggtgaactctcacccgagcggtttctctttccgggacaacatggcgccgtccacgccgctcttgacagtccgaggatcagaaggactgtacatggtgaatggaccaccacattttacagaaagcacagtgtttccaagggaatctgggaagaattgcaaagtctgtatctttagtaaggatgggaccttgtttgcctggggcaatggagaaaaagtaaatattatcagtgtcactaacaagggactactgcactccttcgacctcctgaaggcagtttgccttgaattctcacccaaaaatactgtcctggcaacgtggcagccttacactacttctaaagatggcacagctgggatacccaacctacaactttatgatgtgaaaactgggacatgtttgaaatctttcatccagaaaaaaatgcaaaattggtgtccatcctggtcagaagatgaaactctttgtgcccgcaatgttaacaatgaagttcacttctttgaaaacaacaattttaacacaattgcaaataaattgcatttgcaaaaaattaatgattttgtattatcacctggaccccaaccatacaaggtggctgtctatgttccaggaagtaaaggtgcaccttcatttgttagattatatcagtaccccaactttgctggacctcatgcagctttagctaataaaagtttctttaaggcagataaagttacaatgctgtggaataaaaaagctactgctgtgttggtaatagctagcacagatgttgacaagacaggagcttcctactatggagaacaaactctacactacattgcaacaaatggagaaagtgctgtagtgcaattaccaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattgcatgaagaggaaccacctcagaatatgaaaccacaatcaggaaacgataagccattatcaaaaacagctcttaaaaatcaaaggaagcatgaagctaagaaagctgcaaagcaggaagcaagaagtgacaagagtccagatttggcacctactcctgccccacagagcacaccacgaaacactgtctctcagtcaatttctggggaccctgagatagacaaaaaaatcaagaacctaaagaagaaactgaaagcaatcgaacaactgaaagaacaagcagcaactggaaaacagctagaaaaaaatcagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaacaaagacattttaaatttaa

SEQ ID NO: 10012 - DNA, 4463 bp, Homo sapiens
cccccagtgaaggtgcgcgcgtggcggaggctggttttccgtctggtgaggggttacttccgggtcggacggcgctagctgcagcatcggagtgtggcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagctactttgccagacgtttatcaaaatggggctgctgtcttctttcacttgtagtgacgagtttagctcattgagactacatcacaacagagctattactcacttaatgaggtctgctaaagagagagttcgtcaggatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaaggggtgagggatgacggaaaggatgggggcgtgggatgaaagtggacttaacttttaaggtagttaactggaatgtaaatttttaatctttattagggtatagttggtacaatgcttcgttgtatttagtaagcctttacaagacttgttaaagatgtcagagtgccccaagctgccgttccttcccttcctgccccacaagctccttttcctgaatttcctacctaaatattaaccatatgcctagtctctgaaactaaaaacttggacctcatcctcaattattttctcctttcaactctgttgaccctctgtctggtcttcctctagaaggtaccgcagaaattgatgtgtgctccctgccctcgtcactgcccaagcccgggcctgcacatactcactggactgttccagttttgacagctgccagtcttcctgcccctttcacactgcagctgaagttcattacctgaaggacgcctcatcatttcattccttggctccaaaccttctgctgcctctaagataaaagctcaacttcttaacagtgtacagtgtgcaacttccaacctttttatctgttctctccaccttcagtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcactgaaaagaaaaaacacgccaggtagcatcaccagagcagccctgagggaagtactcgcacagtggggaaggggacagtcaccaaacaccacagactgatgacatgggaaagggtgttttcaagaagaacatcacattttcagtctgtctctaagatgcttactactgaaaagggtttaagtgcaaactatgttaaaaaagtaaccaaagagtcattcctggtatttgattatgacacttctgaagctagaagggacctcagaccacctgctccaatccctgctgcctaaggttttgggggctgagggctggaaacccaggagctgcatctcccaggctcttggcctcataatcgccttctgtgagactgagggcaattaagatatgaatgacatgaactcgcttatctccatatcaacataaaccagaagaggcatacatctgtgggatagtcaatacataacatcctatctttatatggccatatgagaagataacttcagtgtccctatgatggtaagttcttgaatgtgagggcaagatggctgtgatagccatgactccccgctttgcctggttggacagaacccccttccccaaatgctcacagtcccccccttgagctgtgtctcactcagagaccctaaattttgcagacgaacaagggcatctttgcgttgcttcatctctgctcctcctctagaactatcccacaggctttctagacttagaatatctgacctgatgcaaatcgctatgtggccagtatgccacagaatgtcctaaacccttgctgcctcttatcaaaaccatgttgcacatctcatcatatagtacagctaacccttgaacagtgggggggttagggacactgacccccgactgctgtgcagtcgaaaatccacataaaacttctgactccttcaaaacttaagcactaatagcctactattcatgggaagccttacccatcacagttgattaacacgttttgtatggtctgtatattatatgctatattcttacaataaacttgagaaaatgttaagaaaa

SEQ ID NO: 10013 - DNA, 2294 bp, Homo sapiens
ggacggcgctagctgcagcatcggagtgtggcagtgctgggctggccggcgggctgggctgcggcccgcgcgcggccggcgatgcaggggggcaactccggggtccgcaagcgcgaagaggagggcgacggggctggggctgtggctgcgccgccggccatcgactttcccgccgagggcccggaccccgaatatgacgaatctgatgttccagcagaaatccaggtgttaaaagaacccctacaacagccaaccttcccttttgcagttgcaaaccaactcttgctggtttctttgctggagcacttgagccacgtgcatgaaccaaacccacttcgttcaagacaggtgtttaagcgatccttgtgaggatatttctcgtatccagaaaatcagatcaagggaagtagccttggaagcacaaacttcacgttacttaaatgaatttgaagaacttgccatcttaggaaaaggtggatacggaagagtatacaaggtcaggaataaattagatggtcagtattatgcaataaaaaaaatcctgattaagggtgcaactaaaacagtttgcatgaaggtcctacgggaagtgaaggtgctggcaggtcttcagcaccccaatattgttggctatcacaccgcgtggatagaacatgttcatgtgattcagccacgagcagacagagctgccattgagttgccatctctggaagtgctctccgaccaggaagaggacagagagcaatgtggtgttaaaaatgatgaaagtagcagctcatccattatctttgctgagcccaccccagaaaaagaaaaacgctttggagaatctgacactgaaaatcagaataacaagtcggtgaagtacaccaccaatttagtcataagagaatctggtgaacttgagtcgaccctggagctccaggaaaatggcttggctggtttgtctgccagttcaattgtggaacagcagctgccactcaggcgtaattcccacctagaggagagtttcacatccaccgaagaatcttccgaagaaaatgtcaactttttgggtcagacagaggcacagtaccacctgatgctgcacatccagatgcagctgtgtgagctctcgctgtgggattggatagtcgagagaaacaagcggggccgggagtatgtggacgagtctgcctgtccttatgttatggccaatgttgcaacaaaaatttttcaagaattggtagaaggtgtgttttacatacataacatgggaattgtgcaccgagatctgaagccaagaaatatttttcttcatggccctgatcagcaagtaaaaataggagactttggtctggcctgcacagacatcctacagaagaacacagactggaccaacagaaacgggaagagaacaccaacacatacgtccagagtgggtacttgtctgtacgcttcacccgaacagttggaaggatctgagtatgatgccaagtcagatatgtacagcttgggtgtggtcctgctagagctctttcagccgtttggaacagaaatggagcgagcagaagttctaacaggtttaagaactggtcagttgccggaatccctccgtaaaaggtgtccagtgcaagccaagtatatccagcacttaacgagaaggaactcatcgcagagaccatctgccattcagctgctgcagagtgaacttttccaaaattctggaaatgttaacctcaccctacagatgaagataatagagcaagaaaaagaaattgcagaactaaagaagcagctaaacctcctttctcaagacaaagggtttagcgtcattccaaaaccacacccttgcaaagctttgtactccgcaccccagatgatctccaggcagctcagatctctttcctgcctttgccctgcactgttccccggtacttcctcctttattgtagcactcagctccccagccaatctgtacatccctcagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccaggttttcacaagacctcatccacctctgc

SEQ ID NO: 10014 - DNA, 4646 bp, Homo sapiens
ggaaagtccaccttccccaacaaggccagcctgggaacatggagtggcagcggccgcagccaatgagagagcaaacgcgcggaaagtttgctcaatgggcgatgtccgagataggctgtcactcaggtggcagcggcagaggccgggctgagacgtggccaggggaacacggctggctgtccaggccgtcggggcggcagtagggtccctagcacgtccttgccttcttgggagctccaagcggcgggagaggcaggcgtcagtggctgcgcctccatgcctgcgcgcggggcgggacgctgatggagcgcgccatcagcccggggctgctggtacgggcgctgctgctgctgctgctgctgctggggctcgcggcaaggacggtggccgcggggcgcgcccgtggcctcccagcgccgacggcggaggcggcgttcggcctcggggcggccgctgctcccacctcagcgacgcgagtaccggcggcgggcgccgtggctgcggccgaggtgactgtggaggacgctgaggcgctgccggcagccgcgggagagcaggagcctcggggtccggaaccagacgatgagacagagttgcgaccgcgcggcaggtcattagtaattatcagcactttagatgggagaattgctgccttggatcctgaaaatcatggtaaaaagcagtgggatttggatgtgggatccggttccttggtgtcatccagccttagcaaaccagaggtatttgggaataagatgatcattccttccctggatggagccctcttccagtgggaccaagaccgtgaaagcatggaaacagttcctttcacagttgaatcacttcttgaatcttcttataaatttggagatgatgttgttttggttggaggaaaatctctgactacatatggactcagtgcatatagtggaaaggtgaggtatatctgttcagctctgggttgtcgccaatgggatagtgacgaaatggaacaagaggaagacatcctgcttctacagcgtacccaaaaaactgttagagctgtcggacctcgcagtggcaatgagaagtggaatttcagtgttggccactttgaacttcggtatattccagacatggaaacgagagccggatttattgaaagcacctttaagcccaatgagaacacagaagagtctaaaattatttcagatgtggaagaacaggaagctgccataatggacatagtgataaaggtttcggttgctgactggaaagttatggcattcagtaagaagggaggacatctggaatgggagtaccagttttgtactccaattgcatctgcctggttacttaaggatgggaaagtcattcccatcagtctttttgatgatacaagttatacatctaatgatgatgttttagaagatgaagaagacattgtagaagctgccagaggagccacagaaaacagtgtttacttgggaatgtatagaggccagctgtatctgcagtcatcagtcagaatttcagaaaagtttccttcaagtcccaaggctttggaatctgtcactaatgaaaacgcaattattcctttaccaacaatcaaatggaaacccttaattcattctccttccagaactcctgtcttggtaggatctgatgaatttgacaaatgtctcagtaatgataagttttctcatgaagaatatagtaatggtgcactttcaatcttgcagtatccatatgataatggttattatctaccatactacaagagggagaggaacaaacgaagcacacagattacagtcagattcctcgacaacccacattacaacaagaatatccgcaaaaaggatcctgttcttcttttacactggtggaaagaaatagttgcaacgattttgttttgtatcatagcaacaacgtttattgtgcgcaggcttttccatcctcatcctcacaggcaaaggaaggagtctgaaactcagtgtcaaactgaaaataaatatgattctgtaagtggtgaagccaatgacagtagctggaatgacataaaaaactctggatatatatcacgatatctaactgattttgagccaattcaatgcctgggacgtggtggctttggagttgtttttgaagctaaaaacaaagtagatgactgcaattatgctatcaagaggatccgtctccccaatagggaattggctcgggaaaaggtaatgcgagaagttaaagccttagccaagcttgaacacccgggcattgttagatatttcaatgcctggctcgaagcaccaccagagaagtggcaagaaaagatggatgaaatttggctgaaagatgaaagcacagactggccactcagctctcctagcccaatggatgcaccatcagttaaaatacgcagaatggatcctttcgctacaaaagaacatattgaaatcatagctccttcaccacaaagaagcaggtctttttcagtagggatttcctgtgaccagacaagttcatctgagagccagttctcaccactggaattctcaggaatggaccatgaggacatcagtgagtcagtggatgcagcatacaacctccaggacagttgccttacagactgtgatgtggaagatgggactatggatggcaatgatgaggggcactcctttgaactttgtccttctgaagcttctccttatgtaaggtcaagggagagaacctcctcttcaatagtatttgaagattctggctgtgataatgcttccagtaaagaagagccgaaaactaatcgattgcatattggcaaccattgtgctaataaactaactgctttcaagcccaccagtagcaaatcttcttctgaagctacattgtctatttctcctccaagaccaaccactttaagtttagatctcactaaaaacaccacagaaaaactccagcccagttcaccaaaggtgtatctttacattcaaatgcagctgtgcagaaaagaaaacctcaaagactggatgaatggacgatgtaccatagaggagagagagaggagcgtgtgtctgcacatcttcctgcagatcgcagaggcagtggagtttcttcacagtaaaggactgatgcacagggacctcaagccatccaacatattctttacaatggatgatgtggtcaaggttggagactttgggttagtgactgcaatggaccaggatgaggaagagcagacggttctgaccccaatgccagcttatgccagacacacaggacaagtagggaccaaactgtatatgagcccagagcagattcatggaaacagctattctcataaagtggacatcttttctttaggcctgattctatttgaattgctgtatccattcagcactcagatggagagagtcaggaccttaactgatgtaagaaatctcaaatttccaccattatttactcagaaatatccttgtgagtacgtgatggttcaagacatgctctctccatcccccatggaacgacctgaagctataaacatcattgaaaatgctgtatttgaggacttggactttccaggaaaaacagtgctcagacagaggtctcgctccttgagttcatcgggaacaaaacattcaagacagtccaacaactcccatagccctttgccaagcaattagccttaagttgtgctagcaaccctaataggtgatgcagataatagcctacttcttagaatatgcctgtccaaaattgcagacttgaaaagtttgttcttcgctcaatttttttgtggactactttttttatatcaaatttaagctggatttgggggcataacctaatttgagccaactcctgagttttgctatacttaaggaaagggctatctttgttctttgttagtctcttgaaactggctgctggccaagctttatagccctcaccatttgcctaaggaggtagcagcaatccctaatatatatatatagtgagaactaaaatggatatatttttataatgcagaagaaggaaagtccccctgtgtggtaactgtattgttctagaaatatgctttctagagatatgatgattttgaaactgatttctagaaaaagctgactccatttttgtccctggcgggtaaattaggaatctgcactattttggaggacaagtagcacaaactgtataacggtttatgtccgtagttttatagtcctatttgtagcattcaatagctttattccttagatggttctagggtgggtttacagctttttgtacttttacctccaataaagggaaaatgaagctttttatgtaaattggttgaaaggtctagttttgggaggaaaaaagccgtagtaagaaatggatcatatatattacaactaacttcttcaactatggactttttaagcctaatgaaatcttaagtgtcttatatgtaatcctgtaggttggtacttcccccaaactgattataggtaacagtttaatcatctcacttgctaacatgtttttatttttcactgtaaatatgtttatgttttatttataaaaattctgaaatcaatccatttgggttggtggtgtacagaacacacttaagtgtgttaacttgtgacttctttcaagtctaaatgatttaataaaactttttttaaatt

SEQ ID NO: 10015 - DNA, 4402 bp, Homo sapiens
agtagggtccctagcacgtccttgccttcttgggagctccaagcggcgggagaggcaggcgtcagtggctgcgcctccatgcctgcgcgcggggcgggacgctgatggagcgcgccatcagcccggggctgctggtacgggcgctgctgctgctgctgctgctgctggggctcgcggcaaggacggtggccgcggggcgcgcccgtggcctcccagcgcctcagcgacgcgagtaccggcggcgggcgccgtggctgcggccgaggtgactgtggaggacgctgaggcgctgccggcagccgcgggagagcaggagcctcggggtccggaaccagacgatgagacagagttgcgaccgcgcggcaggtcattagtaattatcagcactttagatgggagaattgctgccttggatcctgaaaatcatggtaaaaagcagtgggatttggatgtgggatccggttccttggtgtcatccagccttagcaaaccagaggtatttgggaataagatgatcattccttccctggatggagccctcttccagtgggaccaagaccgtgaaagcatggaaacagttcctttcacagttgaatcacttcttgaatcttcttataaatttggagatgatgttgttttggttggaggaaaatctctgactacatatggactcagtgcatatagtggaaaggtgaggtatatctgttcagctctgggttgtcgccaatgggatagtgacgaaatggaacaagaggaagacatcctgcttctacagcgtacccaaaaaactgttagagctgtcggacctcgcagtggcaatgagaagtggaatttcagtgttggccactttgaacttcggtatattccagacatggaaacgagagccggatttattgaaagcacctttaagcccaatgagaacacagaagagtctaaaattatttcagatgtggaagaacaggaagctgccataatggacatagtgataaaggtttcggttgctgactggaaagttatggcattcagtaagaagggaggacatctggaatgggagtaccagttttgtactccaattgcatctgcctggttacttaaggatgggaaagtcattcccatcagtctttttgatgatacaagttatacatctaatgatgatgttttagaagatgaagaagacattgtagaagctgccagaggagccacagaaaacagtgtttacttgggaatgtatagaggccagctgtatctgcagtcatcagtcagaatttcagaaaagtttccttcaagtcccaaggctttggaatctgtcactaatgaaaacgcaattattcctttaccaacaatcaaatggaaacccttaattcattctccttccagaactcctgtcttggtaggatctgatgaatttgacaaatgtctcagtaatgataagttttctcatgaagaatatagtaatggtgcactttcaatcttgcagtatccatatgataatggttattatctaccatactacaagagggagaggaacaaacgaagcacacagattacagtcagattcctcgacaacccacattacaacaagaatatccgcaaaaaggatcctgttcttcttttacactggtggaaagaaatagttgcaacgattttgttttgtatcatagcaacaacgtttattgtgcgcaggcttttccatcctcatcctcacaggcaaaggaaggagtctgaaactcagtgtcaaactgaaaataaatatgattctgtaagtggtgaagccaatgacagtagctggaatgacataaaaaactctggatatatatcacgatatctaactgattttgagccaattcaatgcctgggacgtggtggctttggagttgtttttgaagctaaaaacaaagtagatgactgcaattatgctatcaagaggatccgtctccccaatagggaattggctcgggaaaaggtaatgcgagaagttaaagccttagccaagcttgaacacccgggcattgttagatatttcaatgcctggctcgaagcaccaccagagaagtggcaagaaaagatggatgaaatttggctgaaagatgaaagcacagactggccactcagctctcctagcccaatggatgcaccatcagttaaaatacgcagaatggatcctttcgctacaaaagaacatattgaaatcatagctccttcaccacaaagaagcaggtctttttcagtagggatttcctgtgaccagacaagttcatctgagagccagttctcaccactggaattctcaggaatggaccatgaggacatcagtgagtcagtggatgcagcatacaacctccaggacagttgccttacagactgtgatgtggaagatgggactatggatggcaatgatgaggggcactcctttgaactttgtccttctgaagcttctccttatgtaaggtcaagggagagaacctcctcttcaatagtatttgaagattctggctgtgataatgcttccagtaaagaagagccgaaaactaatcgattgcatattggcaaccattgtgctaataaactaactgctttcaagcccaccagtagcaaatcttcttctgaagctacattgtctatttctcctccaagaccaaccactttaagtttagatctcactaaaaacaccacagaaaaactccagcccagttcaccaaaggtgtatctttacattcaaatgcagctgtgcagaaaagaaaacctcaaagactggatgaatggacgatgtaccatagaggagagagagaggagcgtgtgtctgcacatcttcctgcagatcgcagaggcagtggagtttcttcacagtaaaggactgatgcacagggacctcaagccatccaacatattctttacaatggatgatgtggtcaaggttggagactttgggttagtgactgcaatggaccaggatgaggaagagcagacggttctgaccccaatgccagcttatgccagacacacaggacaagtagggaccaaactgtatatgagcccagagcagattcatggaaacagctattctcataaagtggacatcttttctttaggcctgattctatttgaattgctgtatccattcagcactcagatggagagagtcaggaccttaactgatgtaagaaatctcaaatttccaccattatttactcagaaatatccttgtgagtacgtgatggttcaagacatgctctctccatcccccatggaacgacctgaagctataaacatcattgaaaatgctgtatttgaggacttggactttccaggaaaaacagtgctcagacagaggtctcgctccttgagttcatcgggaacaaaacattcaagacagtccaacaactcccatagccctttgccaagcaattagccttaagttgtgctagcaaccctaataggtgatgcagataatagcctacttcttagaatatgcctgtccaaaattgcagacttgaaaagtttgttcttcgctcaatttttttgtggactactttttttatatcaaatttaagctggatttgggggcataacctaatttgagccaactcctgagttttgctatacttaaggaaagggctatctttgttctttgttagtctcttgaaactggctgctggccaagctttatagccctcaccatttgcctaaggaggtagcagcaatccctaatatatatatatagtgagaactaaaatggatatatttttataatgcagaagaaggaaagtccccctgtgtggtaactgtattgttctagaaatatgctttctagagatatgatgattttgaaactgatttctagaaaaagctgactccatttttgtccctggcgggtaaattaggaatctgcactattttggaggacaagtagcacaaactgtataacggtttatgtccgtagttttatagtcctatttgtagcattcaatagctttattccttagatggttctagggtgggtttacagctttttgtacttttacctccaataaagggaaaatgaagctttttatgtaaattggttgaaaggtctagttttgggaggaaaaaagccgtagtaagaaatggatcatatatattacaactaacttcttcaactatggactttttaagcctaatgaaatcttaagtgtcttatatgtaatcctgtaggttggtacttcccccaaactgattataggtaacagtttaatcatctcacttgctaacatgtttttatttttcactgtaaatatgtttatgttttatttataaaaattctgaaatcaatccatttgggttggtggtgtacagaacacacttaagtgtgttaacttgtgacttctttcaagtctaaatgatttaataaaactttttttaaatt

SEQ ID NO: 10016 - DNA, 1608 bp, Homo sapiens
ggagcctaggactgagggcgatggctgctgtggccgtggctgttcgcgaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggtta

SEQ ID NO: 10017 - DNA, 1633 bp, Homo sapiens
atgccaacccagcagccggctgcgccgagtactcgtgcccccaaaccctcccggagtctctctggctcactttgtgccctgttttctgatgcagactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgac

SEQ ID NO: 10018 - DNA, 2477 bp, Homo sapiens
cgaggtgctgtgactcgtgccagccccctaatctgcggaagtggagtgcggggagtgcgccggaagaggggtacggaagtgcgccggaagtggggtgcggaggtgtgcagcgcgctgtcagactggctcgcaggcggcgcggccggcggacccgttcgagacagcgcgggcggctcgggtcccctggggctccgcagcaggaggacgccatggacgacaaggagttaattgaatactttaagtctcagatgaaagaagatcctgacatggcctcagcagtggctgccatccggacgttgctggagttcttgaagagagataaaggggagacaatccagggtctgagggcgaatctcaccagtgccatagaaaccctgtgtggtgtggactcctctgtggcagtgtcctctggcggggagctcttcctccgcttcatcagtcttgcctccctggaatactccgattactccaaatgtaaaaagatcatgattgagcggggagaactttttctcaggagaatatcactgtcaagaaacaaaattgcagatctgtgccatactttcatcaaagatggagcgacaatattgactcacgcctactccagagtggtcctgagagtcctggaagcagccgtggcggccaagaagcgatttagtgtatacgtcacagagtcacagcctgatttgtcaggtaagaaaatggccaaagccctctgccacctcaacgtccctgtcactgtggtgctagatgctgctgtcggctacatcatggagaaagcagatcttgtcatagttggtgctgaaggagttgttgaaaacggaggaattattaacaagattggaaccaaccagatggctgtgtgtgccaaagcacagaacaaacctttctatgtggttgcagaaagtttcaagtttgtccggctctttccactaaaccagcaagacgtcccagataagtttaagtataaggcagacactctcaaggtcgcgcagactggacaagacctcaaagaggagcatccgtgggtcgactacactgccccttccttaatcactctgctgtttacagacctgggcgtgctgacaccctcagcagtcagcgatgagctcatcaagctctatctgtaacctgtgagccctttcctgccaaggtgcagcttacgtagttgaggcagggtgagtagctgcttgacaccccagtgagtcaggccaaaactgagatgtgtttaatgaagatttatggagtaaggacttaaaatcatacatcttggagaacctttcttactcatttcagtcccatctaaaaatgtgtcagctattctaaatcccaacttaaattgttcttacggtttctagaaactttccttttcagtttccagaaatacaagttagataattggctacttaactgatgaaagatgagcccaagtccacctgtcttcatcctcccctgcactccagactgatctgcctaaagcacgcgagatgcaggcgaaaagcagccacacccctctgccacaaatgaccaacagctggtcaggacgttacacgcggtgccttgtaagaggcaagaaacacttgctgaatctgcatctggcttccagtggtaagcacattcctcagcaggatcaagccaaacagtaaaaactaccaagagaacacgaggaaggcagaaacgatgtttagcaacagtattctgcatggttcactgcttaagaaaatgccttctggaatatttgtaaactgaaattctgtatgtgtaagagatgtttaaatatgtttgggtcctaaacagctttttaaaattatacttgggaataaattcagcatcttttcaaataaactctatgaaagacgctgatgtggtgttgcatcaatactgcaagctgaccaggccatctaggggaaaacactgtccagctacatttacacacttaagacccaggcaatcaggacaccatttattcaacaggaggcataaaaactataattctctttcccggaatatgacttaatccctctgtttttcagctattcaccaataaaacaatactgtgactattaacacagaaaaaccccagcacattagccacccctgcaggacatcaaaggataactgaagcccagggccaagcacattcaggaggtcaaatgcctgaagatactgaggaatggttttgaaaatcagaagtcaagaagacttctgtatctttatgtttaaaaataactataaaatagcctcagaaaaaagagcttatatatatatatatatatatatatatatatatatatatatatatataatatgtacatatgtctatatgtgacccatcatgataaatactgacatctattatttacactcaaataattttacattttcttctgttagactactccaagactggaattgttttgttttgttgtttttaatgagagggtctcgctgtgttcccaggctggtcttgaactcctggg

SEQ ID NO: 10019 - DNA, 1537 bp, Homo sapiens
cgcccgccccggaagtgcaaactgtgtggtctggcaggtgtggattccgccggtgaaggctgaaggcagctaccttaaagatgccgggatccgcagcgaagggctcggagttgtcagagaggatcgagagcttcgtggagaccctgaagcggggtggtgggccgcgcagctccgaggaaatggctcgggagaccctagggttgctgcgccagatcatcacggaccaccgctggagcaacgcgggggagctgatggagctgatccgcagagagggcaggaggatgacggccgctcagccctccgagaccaccgtgggcaacatggtgcggagagtgctcaagattatccgggaggagtatggcagactccatggacgcagcgacgagagtgatcagcaggagtccctgcacaaactgttgacatccggaggcctaaacgaggatttcagcttccattatgcccaactccagtccaacatcattgaggcgattaatgagctgctagtggagctggaagggacaatggagaacattgcagcccaggctctggagcacattcactccaatgaggtgatcatgaccattggcttctcccgaacagtagaggccttcctcaaagaggctgcccgaaagaggaaattccatgtcattgtagcagagtgtgctcctttctgccagggtcatgaaatggctgtgaatttgtccaaagcaggtattgagacaactgtcatgactgatgctgccatttttgccgttatgtcaagagtcaacaaggtgatcattggcacgaagaccatcctggccaatggggccctgagagctgtgacaggaactcacactctggcactggcagcaaaacaccattccaccccactcatcgtctgtgcacctatgttcaaactttctccacagttccccaatgaagaagactcatttcataagtttgtggctcctgaagaagtcctgccattcacagaaggggacattctggagaaggtcagcgtgcattgccctgtgtttgactacgttcccccagagctcattaccctctttatctccaacattggtgggaatgcaccttcctacatctaccgcctgatgagtgaactctaccatcctgatgatcatgttttatgaccgaccacacgtgtcctaagcagattgcttaggcagatacagaatgaagaggagacttgagtgttgctgctgaagcacatccttgcaatgtgggagtgcacaggagtccacctaaaaaaaaaatccttgatactgttgcctgcctttttagtcaccccgtaacaagggcacacatccaggactgtgtcttgcctttcagatcttaacagagcagcagggcttaacttgttgattttggagcctcttagtgacctggttgcgtctgtgtcaggaacttaaactttctggttcagtagtgtgttaaacataacactgaataccttactgggatacagatttttgctcagaaatggctatgacactttttctaggctctaccaataaaagccacttgaaggttc

SEQ ID NO: 10020 - DNA, 1659 bp, Homo sapiens
attgggctgtcagtcagaggcggcgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaaggaagcaatatccaaggcagtgtcatctgcaacaatgctgtgatcgagaagggtgcagacatcaaggactgcttgattggaagtggccagaggattgaagccaaagctaaacgagtgaatgaggtgatcgtggggaatgaccagctcatggagatctgagttctgagcaagtcagactccttccttttggcctccaaagccacagatgttggccggcccacctgtttaactctgtatttatttcccaataaagaagggcttccaaaggcatgctggagacttgtggagcagtccaaagctccatgtcaggtgggctccaggtgtacacagtg

SEQ ID NO: 10021 - DNA, 705 bp, Homo sapiens
cagaggcggcgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagatggagactcgctctgttgccaggctggagtgcagtggcaccatctcggttcactccaatctccacctcccgggttcaagcacttcacctgcctcagcctcccgagtagctgggactacatgcacatgccaccacacc

SEQ ID NO: 10022 - DNA, 1457 bp, Homo sapiens
cgtggagatcgctgggagcggttgcggcgtgccgggagctgagttatagctgtgacttctgccctgccaggccgcacacaagctggctgacccggtttgtaaaaatggaatttcaagcagtagtgatggcagtaggtggaggatctcggatgacagacctaacttccagcattcccaaacctctgcttccagttgggaacaaacctttaatttggtacccattgaacctgcttgagcgtgttggatttgaagaagtcattgtggttacaaccagggatgttcaaaaggctctatgtgcagaattcaagatgaaaatgaagccagatattgtgtgtattcctgatgacgctgacatgggaactgcagattctttgcgctacatatatccaaaacttaagacagatgtgctggtgctgagctgtgatctgataacagacgttgccttacatgaggttgtggacctgtttagagcttatgatgcatcacttgctatgttgatgagaaaaggccaagatagcatagaacctgttcccggtcaaaaggggaaaaaaaaagcagtggagcagcgtgacttcattggagtggacagcacaggaaagaggctgctcttcatggctaatgaagcagacttggatgaagagctggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaagggtatgtttccccctgtacccacttgaggcaaagataatggaaaaatgccttcaaaattctgaaggaaggttaattttaacctaaaattgtatacccaggcaaagtgctaatcaagagggcaatagaataaaaacattttcagatatcaaaa

SEQ ID NO: 10023 - DNA, 890 bp, Homo sapiens
tggtcattaagggatccatcctacagaagcatcctagaatacgtttccacacgggtcttgtggatgcccacctctactgtttgaaaaaatacatcgtggatttcctaatggaaaatgggtcaataacttctatccggagtgaactgattccatatttagtgagaaaacagttttcctcagcttcctcacaacagggacaagaagaaaaagaggaggatctaaagaaaaaggagctgaagtccttagatatctacagttttataaaagaagccaatacactgaacctggctccctatgatgcctgctggaatgcctgtcgaggagacaggtgggaagacttgtccagatcacaggtgcgctgctatgtccacatcatgaaagaggggctctgctctcgagtgagcacactgggactctacatggaagcaaacagacaggtgcccaaattgctgtctgctctctgtccagaagaaccaccagtccattcgtcagcccagattgtcagcaaacacctggttggagttgacagcctcattgggccagagacacagattggagagaagtcatccattaagcgctcagtcattggctcatcctgtctcataaaagatagagtgactattaccaattgccttctcatgaactcagtcactgtggaggaaggctaaacgagtgaatgaggtgatcgtggggaatgaccagctcatggagatctgagttctgagcaagtcagactccttccttttggcctccaaagccacagatgttggccggcccacctgtttaactctgtatttatttcccaataaagaagggcttccaaaggcatgctggagacttgtggagcagtccaaagctccatgtcaggtgggctccaggtgtacacagtg

SEQ ID NO: 10024 - DNA, 1792 bp, Homo sapiens
agtgcggggcggggcctcggggcccgtcggaaattgtagtccgattggggctgcgcgcttcgcttctgcggctcagcctccagcccaggtggcgctgtggaccctgcagccgcggagcgaggcagcggggcggctccgtgaccacggcgggcggagcctaggactgagggcgatggctgctgtggccgtggctgttcgcgaggactcgggatccgggatgaaggcggagcttccccctgggcctggggcagtggggagggaaatgaccaaagaagaaaagctgcagcttcggaaggaaaagaaacagcagaagaagaaacggaaggaagaaaagggggcagaaccagagactggctctgctgtatctgcagcccaatgtcaagtaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctcagcaa

SEQ ID NO: 10025 - DNA, 1626 bp, Homo sapiens
gagcctaggactgagggcgatggctgctgtggccgtggctgttcgcgaggactcgggatccgggatgaaggcggagtccccctgggcctgggtggggagggaaatgaccaaagaagaaaagctgcagcttcggaaggaaaagaaacagcagaagaagaaacggaaggaagaaaagggggcagaaccagagactggctctgctgtatctgcagcccaatgtcaaggcccaaccagagaactgccagaatcgggcattcagttgggcactcctcgggagaaagttccagctggtcggagtaaggccgaacttcgggctgagcgtcgagccaagcaggaggccgagcgggccctgaaacaggcaagaaaaggggaacaaggaggaccacctcctaaggccagccccagcacagctggagaaaccccctcaggagtgaagcgtctccctgagtaccctcaggttgatgacctacttctgagaaggcttgttaaaaaaccagagcgtcaacaggttcctacacgaaaggattatggatccaaagtcagtctcttctctcacctaccccagtacagcagacaaaactctctgacccagtttatgagcatcccatcctctgtgatccacccagccatggtgcgactcggcctgcagtactcccagggcctggtcagtggctccaatgcccggtgtattgccctgcttcgtgccttgcagcaggtgattcaggattacacaacaccgcctaatgaagaactctccagggatctagtgaataaactaaaaccctacatgagcttcctgactcagtgccgtcccctgtcagcgagcatgcacaacgccatcaagttccttaacaaggaaatcaccagtgtgggcagttccaagcgggaagaggaggccaagtcagaacttcgagcagccattgatcggtatgtgcaagagaagattgtgctagcagctcaggcaatttcacgctttgcttaccagaagatcagtaatggagatgtgatcctggtatatggatgctcatctctggtatcacgaattcttcaggaggcttggacagagggccggcggtttcgggtggtagtggtggacagccggccatggctggaaggaaggcacacactacgttctctagtccatgctggtgtcccagcctcctacctgctgattcctgcagcctcctatgtgctcccagaggtttccaaggtgctattgggagctcatgcactcttggccaacgggtctgtgatgtcacgggtagggacagcacagttagccctggtggctcgagcccataatgtaccagtgctggtttgctgtgaaacatacaagttctgtgagcgtgtgcagactgatgcctttgtctctaatgagctagatgaccctgatgatctgcaatgtaagcggggagaacatgttgcgctggctaactggcagaaccacgcatccctacggttgttgaatctagtctatgatgtgactcccccagagcttgtggatctggtgatcacggagctggggatgatcccttgcagttctgtacctgttgttctacgagtcaagagcagtgaccagtgacgggggaaacacagggttaataaatgccatactccctaccctca

SEQ ID NO: 10026 - DNA, 2655 bp, Homo sapiens
tccctcctcgtctccttcccttcgttaattagtccatcgcatttcaagtgctggatcctttttgtcccctactgcgtgcggtggcagcttccttgcggaagtggtgaccgtgagagaagaagatggcggcccctgtagtggcgccgcctggtgtggtggttagtcgggctaacaagcgcagcggcgcggggccgggaggcagcggtggcgggggagccagaggggcggaggaggaaccgccgccgcccctacaagcagttctggtggccgatagcttcgatcgccgcttcttccccatctccaaggaccagcctcgggtcctcttgcccctggccaatgtggcattaattgactacactctggaattcctgactgccacaggtgtacaggaaacatttgtcttttgttgctggaaagctgctcaaatcaaagaacatttactgaagtcaaagtggtgccgccctacatctctcaatgtggttcgaataattacatcagagctctatcgatcactgggagatgtcctccgtgatgttgatgccaaggctttggtgcgctctgactttcttctggtgtatggggatgtcatctcaaacatcaatatcaccagagcccttgaggaacacaggttgagacggaagctagaaaaaaatgtttctgtgatgacgatgatcttcaaggagtcatcccccagccacccaactcgttgccacgaagacaatgtggtagtggctgtggatagtaccacaaacagggttctccattttcagaagacccagggtctccggcgttttgcatttcctctgagcctgtttcagggcagtagtgatggagtggaggttcgatatgatttactggattgtcatatcagcatctgttctcctcaggtggcacaactctttacagacaactttgactaccaaactcgagatgactttgtgcgaggtctcttagtgaatgaggagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagagtggtgt

SEQ ID NO: 10027 - DNA, 1801 bp, Homo sapiens
ccacctcagccttccaaaatgctgggattacaggtggcacaactctttacagacaactttgactaccaaactcgagatgactttgtgcgaggtctcttagtgaatgaggagatcctagggaaccagatccacatgcacgtaacagctaaggaatatggtgcccgtgtctccaacctacacatgtactcagctgtctgtgctgacgtcatccgccgatgggtctaccctctcaccccagaggcgaacttcactgacagcaccacccagagctgcactcattcccggcacaacatctaccgagggcctgaggtcagcctgggccatggcagcatcctagaggaaaatgtgctcctgggctctggcactgtcattggcagcaattgctttatcaccaacagtgtcattggccccggctgccacattggtgataacgtggtgctggaccagacctacctgtggcagggtgttcgagtggcggctggagcacagatccatcagtctctgctttgtgacaatgctgaggtcaaggaacgagtgacactgaaaccacgctctgtcctcacttcccaggtggtcgtgggcccaaatatcacgctgcctgagggctcggtgatctctttgcaccctccagatgcagaggaagatgaagatgatggcgagttcagtgatgattctggggctgaccaagaaaaggacaaagtgaagatgaaaggttacaatccagcagaagtaggagctgctggcaagggctacctctggaaagctgcaggcatgaacatggaggaagaggaggaactgcagcagaatctgtggggactcaagatcaacatggaagaagagagtgaaagtgaaagtgagcaaagtatggattctgaggagccggacagccggggaggctcccctcagatggatgacatcaaagtgttccagaatgaagttttaggaacactacagcggggcaaagaggagaacatttcttgtgacaatctcgtcctggaaatcaactctctcaagtatgcctataacataagtctaaaggaggtgatgcaggtactgagccacgtggtcctggagttccccctgcaacagatggattccccgcttgactcaagccgctactgtgccctgctgcttcctctgctaaaggcctggagccctgtttttaggaactacataaagcgcgcagccgaccatttggaagcgttagcagccattgaggacttcttcctagagcatgaagctcttggtatttccatggccaaggtactgatggctttctaccagctggagatcctggctgaggaaacaattctgagctggttcagccaaagagatacaactgacaagggccagcagttgcgcaagaatcaacagctgcagaggttcatccagtggctaaaagaggcagaagaggagtcatctgaagatgactgaagtcacactgcctgctcctttgggtgtgattgagtgccctcctggctcctgggctgggacaagtgaggaactagctgcagagggatgagtgaccaccatccaggctgagactgaaaggagcagaggctggaactacagtattctttcccctgctagcaaccatgtgcctcccatcctgactgtggagttgggatgtggaagtggggctggaacaaagcttctgcctagggaggagctaagcaggcccggcagttggaggaaggccagaggaacagctttgtgctccggctttccctcagggaacagcagagagcagttggctctttctgctgcttgtatatgttaatattaaaagagagagtggtgt

SEQ ID NO: 10028 - DNA, 7479 bp, Homo sapiens
actggcagctggccgggcgctcgcagtgggagctgctgcaggctccgcggcggcggcaacggaggctgcgggggcggcggcgcgagcggccgggcttggtaggggagccgagcccggcccgggatcccgagcagcgagagtgtggggtacctaggcccctcacgctggacttcacagtctccgggccgcctgacctccgcacgggtatatgggatggaagcgggaccctcgggagcagctgcgggcgcttacctgccccccctgcagcaggtgttccaggcacctcgccggcctggcattggcactgtggggaaaccaatcaagctcctggccaattactttgaggtggacatccctaagatcgacgtgtaccactacgaggtggacatcaagccggataagtgtccccgtagagtcaaccgggaagtggtggaatacatggtccagcatttcaagcctcagatctttggtgatcgcaagcctgtgtatgatggaaagaagaacatttacactgtcacagcactgcccattggcaacgaacgggtcgactttgaggtgacaatccctggggaagggaaggatcgaatctttaaggtctccatcaagtggctagccattgtgagctggcgaatgctgcatgaggccctggtcagcggccagatccctgttcccttggagtctgtgcaagccctggatgtggccatgaggcacctggcatccatgaggtacacccctgtgggccgctccttcttctcaccgcctgagggctactaccacccgctggggggtgggcgcgaggtctggttcggctttcaccagtctgtgcgccctgccatgtggaagatgatgctcaacattgatgtctcagccactgccttttataaggcacagccagtgattgagttcatgtgtgaggtgctggacatcaggaacatagatgagcagcccaagcccctcacggactctcagcgcgttcgcttcaccaaggagatcaagggcctgaaggtggaagtcacccactgtggacagatgaagaggaagtaccgcgtgtgtaatgttacccgtcgccctgctagccatcagacattccccttacagctggagagtggacagactgtggagtgcacagtggcacagtatttcaagcagaaatataaccttcagctcaagtatccccatctgccctgcctacaagttggccaggaacaaaagcatacctaccttcccctagaggtctgtaacattgtggctgggcagcgctgtattaaaaagctgaccgacaaccagacctcgaccatgataaaggccacagctagatccgctccagacagacaggaggagatcagtcgcctgatgaagaatgccagctacaacttagatccctacatccaggaatttgggatcaaagtgaaggatgacatgacggaggtgacagggcgagtgctgccggcgcccatcttgcagtacggcggccggaaccgggccattgccacacccaatcagggtgtctgggacatgcgggggaaacagttctacaatgggattgagatcaaagtctgggccatcgcctgcttcgcaccccaaaaacagtgtcgagaagaggtgctcaagaacttcacagaccagctgcggaagatttccaaggatgcggggatgcctatccagggtcaaccttgtttctgcaaatatgcacagggggcagacagcgtggagcctatgttccggcatctcaagaacacctactcagggctgcagctcattattgtcatcctgccagggaagacgccggtgtatgctgaggtgaaacgtgtcggagatacactcttgggaatggctacgcagtgtgtgcaggtgaagaacgtggtcaagacctcacctcagactctgtccaacctctgcctcaagatcaatgtcaaacttggtggcattaacaacatcctagtcccacaccagcgctctgccgtttttcaacagccagtgatattcctgggagcagatgttacacaccccccagcaggggatgggaaaaaaccttctatcacagcagtggtaggcagtatggatgcccaccccagccgatactgtgctactgtgcgggtacagcgaccacggcaagagatcattgaagacttgtcctacatggtgcgtgagctcctcatccaattctacaagtccacccgtttcaagcctacccgcatcatcttctaccgagatggggtgcctgaaggccagctaccccagatactccactatgagctactggccattcgtgatgcctgcatcaaactggaaaaggactaccagcctgggatcacttatattgtggtgcagaaacgccatcacacccgccttttctgtgctgacaagaatgagcgaattgggaagagtggtaacatcccagctgggaccacagtggacaccaacatcacccacccatttgagtttgacttctatctgtgcagccacgcaggcatccagggcaccagccgaccatcccattactatgttctttgggatgacaaccgtttcacagcagatgagctccagatcctgacgtaccagctgtgccacacttacgtacgatgcacacgctctgtctctatcccagcacctgcctactatgcccgcctggtggctttccgggcacgataccacctggtggacaaggagcatgacagtggagaggggagccacatatcggggcagagcaatgggcgggacccccaggccctggccaaagccgtgcaggttcaccaggatactctgcgcaccatgtacttcgcttgaaggcagaacgctgttacctcactggatagaagaaagctttccaagccccaggagctgtgccacccaaatccagaggaagcaaggaggagggaggtggggtagggaggagtgtaggatgccttgtttccttctatagaggtggtgtaagagtggggaacagggccagcaagacagaccaccagccagaaatctctgatatcaacctcatgtcccccacccctcaccccatcttgtcacatctggccctgaccccactggaccaaaaggggcagcactggtgcccaccatacacacaggtgtctcatgtgactcacagtgctaaagactcatgcttgacagcttggtaaggtcaactctgtagccctgcagacaaaagctggttaggtttgggtttgatactttagatgggaaagtgaggggcttgagaaagtgggtgggaggagggaaggattttttaggagccttaatcagaaaaggactagatttgtttaagaagaaaaatgaaaccagacccagatcaatattttaggatactagatgttttaatgggttcagaatccagtttgtaggaagattttttaatggttttggttgctcctcccccagctgccaccccccaccttacccttattcctctctgtccacattttctgccccaccttacttctcctccctgacagacatccagcccctagtaatacttaaggcactatggcacttagctttgaagtgacacgaccctgtcttccttccgcccgctggtgggtaaccagtgccttccctgtaacggtaatgctgcagaactgcaaccttttgtacctttctttggggaatggggtgggggtgggagaggaggtagatggggaagaaataccccagacccaacaaacctccagccagaaagccagctattttgcatttgaaggaattgacttcctcattcattgagctttttaaaagatcacaacctcaagatggttaaaatccattgacatttgcactttcaaacatgacaagtctcggagctgctgagatgacaggcccctggcctttccacttatgcctccttttctccttattcctcctacctcccgccccgcccaggtctggagttactttcatagcatttttcactcttggcttcttttctcccttgatggtcaagtctcttatgtttcaatatttcttaactggggtgtcttataacaaaaaactcttaggtctaaaatgagaaaaaagagagaaaacaaaatgttatttttataccataacttgagtgtattgccaaaatttggaaatccttcccatgcctgatgagtttatatcccagaaacattgagccatcagaatgaactgtgtacctgatttgttctctgacctggctaggtagggagggggtggttatcgccccaagatggggtccaggctccatccttcctctgtgcagataatacctttttcttgctatagcctccctcctctgcactgtcctgcactctttcttgcaagtgcatctttttccttcccctggactgtcctctgaccctttggctcatcctagattgcagtgtgtcctgtggacaggctggggaattttgctgctccctattgcttctgtttacaaaaatgaatttttcctggtttcccactagggcatgtgggtgggtggcatggacttttttttttttttttttttgtcttgagacatggggtttggctgtcttgcaggactggagaaggtggtggttctagcttggtctctgttggccttgaagcaagcatcccccctgccctttttccttgactgttcatttttttcctgccccactgcttgggatggggagttgcaacttcagtgtggaatttcctctttgaggagcctgggcttggatctatcctgatctggtgatgaagccatgattactttagacctagcccaggcttggaggccagctggaggaagaagggtctaaatcctggcctgtagagttagaactaccatttcctccccttagctgcccttgtatgacccggatttgctatgcaaaacaatctatcccaggttctgttctggttggctacattgttcagcaactcacaaaacgtagcacaaacattcattatggagaaagcatcaggactgttgagtaactcctcctttacttttttcctgctggctacagcatggggtgccctataggcacaagcccagctgaagaacagaatggagggctctgggaggaggcagctcactggagagcctacattccttacacaagtgcctaaagagagtgatgctaacactccatctgccctgtccattgccttcatatacagtctacttcgtgttctgtcaccctttggggaggggagttctcctgggacagtgggctctgcatgttctccacttggatacattttggggctaggatcagggcactattcctggagggtccagtcattcaccagcatttgcaaatgtccatagggagcaggtggcagcctctactcccagcaacaagtttgtgttctctccttttctctctttgcctcactctctccagttggttttcagctggggcttgaaatgcatttttagccctttgacgtggcttatgccattcaagaaataaaaagcaagagaatcagctttgggcaatgacaagaaatgagttcttactctgatttttttgtaaaaagataatttttgagacttgaaaaataccccgaccttgagattattcctgtttgaaaggtggtgcatgcagatggagaagtggtgttggcagcaagctttggctcatgtggatttggtttaagtggtgcttcttacccaagcttcaaggaagtgcttgggggacccccagcctcatcctcttagttgggtctcttgttccctttgtaccactgttttgccttccttttcctcttctctctttgcctggcttcctttcccttttcttctattcactctgcttgcttgctggccggcctgcctgcctgcctgcctgcctgcctgcctgtctgcctatgtgatgatgaaatctctgcatggctgcaatgatcccactgttagctggcagggtcaggcttagctccttgactgcagaagaccaagaacctgttccccaagcccagagatgtccacctgggctggactgccctcaagcttatactagagaagagcaactgacctgcccaacttgtgtgaagtcaggagggtttctggcattttccacacctgtccactccttggagctggtttctctcattgctttttctaaatctggttctttttctctttacctggggcctggcttttctgagattgtcttagggttgagctatttgggtatcctgggtttgagtgttaggggatggacataaaggaaaaagagtgatgagaagagaatggagagaatttgaataaaaggtgggaaaggagagcactgttctttgattgtttatccagtccaacctgatccattagggatcgaggtgctacactggcctccagggataagcctggggctactgttgctgggaacttaggcttaacataaagccgaagaaggtacctagaaatttgaaacttccctaaaaagctcctaatgcccacctgctagatagcttctctgtggcctcctatttagctaagcagcagtgtttttggatactttttttttctgtttgtgaataaggccagcactcaagatgggcagccaagggtgcactgactattagctggcccataggatatctgtaaggctggtgggacagttttggacctggaatcatgtgtaactaacaaggttggacgtttcttccccatcagggtagaaaaatcatctcaaactagccaaaaggcagttttggaaactacattgggggacgttatttttatttatatatggggcctaggccaatccaggatggtagctggaataccttccttcttaaaatctgatcatggcagggatatgcagggcactttttactatttggccttctaagcagattgggaaggaggtattttctggttttcgctttcctccgacttaataggacttgccttctccctgggcagggagagaggctgggttggtgctctcccttactctactcatactgacttagagcctctggctgctgtttgggcatccaagaaagggaggggaaggaatgagctaaaaacaaaacagaatgaggtgggaaagggagattttcttctttacagaggaaaataggaaaccctccaagaattgtgcaagtaaagacatttgttgaatgcactgagtcccttggtgtagtagcaataaggaaaaatgaaattactttcctgtgcacacagtccagcctaattggtatgtgatgttgcacttagcagccatgtggtgggcatgtgtgactactctggttttcactttagtttctaaactttttatccctctcaagtccagcatggatggggaaatgtctctggatccccacagctgtgtacttgtttgcatttgtttccctttgagatttgtgtttgtgtcctgctttgagctgtaccttgtccagtccattgtgaaattatcccagcagctgtaatgtacagttccttctgaagcaagcaacatcagcagcagcagcagcagcagcacaattctgtgttttataaagacaacagtggcttctatttctaaa

SEQ ID NO: 10029 - DNA, 3996 bp, Homo sapiens
tgaggcaagcgcctcaggagtgcgtgaggcccacgcagaactcggggagccttttatcctgaggacacaggggaagaattggaggactatattcagctgcgggcgcttacctgccccccctgcagcaggtgttccaggcacctcgccggcctggcattggcactgtggggaaaccaatcaagctcctggccaattactttgaggtggacatccctaagatcgacgtgtaccactacgaggtggacatcaagccggataagtgtccccgtagagtcaaccgggaagtggtggaatacatggtccagcatttcaagcctcagatctttggtgatcgcaagcctgtgtatgatggaaagaagaacatttacactgtcacagcactgcccattggcaacgaacgggtcgactttgaggtgacaatccctggggaagggaaggatcgaatctttaaggtctccatcaagtggctagccattgtgagctggcgaatgctgcatgaggccctggtcagcggccagatccctgttcccttggagtctgtgcaagccctggatgtggccatgaggcacctggcatccatgaggtacacccctgtgggccgctccttcttctcaccgcctgagggctactaccacccgctggggggtgggcgcgaggtctggttcggctttcaccagtctgtgcgccctgccatgtggaagatgatgctcaacattgatgtctcagccactgccttttataaggcacagccagtgattgagttcatgtgtgaggtgctggacatcaggaacatagatgagcagcccaagcccctcacggactctcagcgcgttcgcttcaccaaggagatcaagggcctgaaggtggaagtcacccactgtggacagatgaagaggaagtaccgcgtgtgtaatgttacccgtcgccctgctagccatcagacattccccttacagctggagagtggacagactgtggagtgcacagtggcacagtatttcaagcagaaatataaccttcagctcaagtatccccatctgccctgcctacaagttggccaggaacaaaagcatacctaccttcccctagaggtctgtaacattgtggctgggcagcgctgtattaaaaagctgaccgacaaccagacctcgaccatgataaaggccacagctagatccgctccagacagacaggaggagatcagtcgcctgatgaagaatgccagctacaacttagatccctacatccaggaatttgggatcaaagtgaaggatgacatgacggaggtgacagggcgagtgctgccggcgcccatcttgcagtacggcggccggaaccgggccattgccacacccaatcagggtgtctgggacatgcgggggaaacagttctacaatgggattgagatcaaagtctgggccatcgcctgcttcgcaccccaaaaacagtgtcgagaagaggtgctcaagaacttcacagaccagctgcggaagatttccaaggatgcggggatgcctatccagggtcaaccttgtttctgcaaatatgcacagggggcagacagcgtggagcctatgttccggcatctcaagaacacctactcagggctgcagctcattattgtcatcctgccagggaagacgccggtgtatgctgaggtgaaacgtgtcggagatacactcttgggaatggctacgcagtgtgtgcaggtgaagaacgtggtcaagacctcacctcagactctgtccaacctctgcctcaagatcaatgtcaaacttggtggcattaacaacatcctagtcccacaccagcgctctgccgtttttcaacagccagtgatattcctgggagcagatgttacacaccccccagcaggggatgggaaaaaaccttctatcacagcagtggtaggcagtatggatgcccaccccagccgatactgtgctactgtgcgggtacagcgaccacggcaagagatcattgaagacttgtcctacatggtgcgtgagctcctcatccaattctacaagtccacccgtttcaagcctacccgcatcatcttctaccgagatggggtgcctgaaggccagctaccccagatactccactatgagctactggccattcgtgatgcctgcatcaaactggaaaaggactaccagcctgggatcacttatattgtggtgcagaaacgccatcacacccgccttttctgtgctgacaagaatgagcgaattgggaagagtggtaacatcccagctgggaccacagtggacaccaacatcacccacccatttgagtttgacttctatctgtgcagccacgcaggcatccagggcaccagccgaccatcccattactatgttctttgggatgacaaccgtttcacagcagatgagctccagatcctgacgtaccagctgtgccacacttacgtacgatgcacacgctctgtctctatcccagcacctgcctactatgcccgcctggtggctttccgggcacgataccacctggtggacaaggagcatgacagtggagaggggagccacatatcggggcagagcaatgggcgggacccccaggccctggccaaagccgtgcaggttcaccaggatactctgcgcaccatgtacttcgcttgaaggcagaacgctgttacctcactggatagaagaaagctttccaagccccaggagctgtgccacccaaatccagaggaagcaaggaggagggaggtggggtagggaggagtgtaggatgccttgtttccttctatagaggtggtgtaagagtggggaacagggccagcaagacagaccaccagccagaaatctctgatatcaacctcatgtcccccacccctcaccccatcttgtcacatctggccctgaccccactggaccaaaaggggcagcactggtgcccaccatacacacaggtgtctcatgtgactcacagtgctaaagactcatgcttgacagcttggtaaggtcaactctgtagccctgcagacaaaagctggttaggtttgggtttgatactttagatgggaaagtgaggggcttgagaaagtgggtgggaggagggaaggattttttaggagccttaatcagaaaaggactagatttgtttaagaagaaaaatgaaaccagacccagatcaatattttaggatactagatgttttaatgggttcagaatccagtttgtaggaagattttttaatggttttggttgctcctcccccagctgccaccccccaccttacccttattcctctctgtccacattttctgccccaccttacttctcctccctgacagacatccagcccctagtaatacttaaggcactatggcacttagctttgaagtgacacgaccctgtcttccttccgcccgctggtgggtaaccagtgccttccctgtaacggtaatgctgcagaactgcaaccttttgtacctttctttggggaatggggtgggggtgggagaggaggtagatggggaagaaataccccagacccaacaaacctccagccagaaagccagctattttgcatttgaaggaattgacttcctcattcattgagctttttaaaagatcacaacctcaagatggttaaaatccattgacatttgcactttcaaacatgacaagtctcggagctgctgagatgacaggcccctggcctttccacttatgcctccttttctccttattcctcctacctcccgccccgcccaggtctggagttactttcatagcatttttcactcttggcttcttttctcccttgatggtcaagtctcttatgtttcaatatttcttaactggggtgtcttataacaaaaaactcttaggtctaaaatgagaaaaaagagagaaaacaaaatgttatttttataccataacttgagtgtattgccaaaatttggaaatccttcccatgcctgatgagtttatatcccagaaacattgagccatcagaatg

SEQ ID NO: 10030 - DNA, 3572 bp, Homo sapiens
ggccgcgccggggcggatcgtgcggccggcggctccctcgcggctcgcggcgtcggggcccgtggcgcgcgcgcggccgcccctcggccccggagcccctcggcggcgccaccatgtactcgggagccggccccgcacttgcacctcctgcgccgccgccccccatccaaggatatgccttcaagcctccacctagacccgactttgggacctccgggagaacaatcaaattacaggccaatttcttcgaaatggacatccccaaaattgacatctatcattatgaattggatatcaagccagagaagtgcccgaggagagttaacagggaaatcgtggaacacatggtccagcactttaaaacacagatctttggggatcggaagcccgtgtttgacggcaggaagaatctatacacagccatgccccttccgattgggagggacaaggtggagctggaggtcacgctgccaggagaaggcaaggatcgcatcttcaaggtgtccatcaagtgggtgtcctgcgtgagcttgcaggcgttacacgatgcactttcagggcggctgcccagcgtcccttttgagacgatccaggccctggacgtggtcatgaggcacttgccatccatgaggtacacccccgtgggccgctccttcttcaccgcgtccgaaggctgctctaaccctcttggcgggggccgagaagtgtggtttggcttccatcagtccgtccggccttctctctggaaaatgatgctgaatattgatgtgtcagcaacagcgttttacaaggcacagccagtaatcgagtttgtttgtgaagttttggattttaaaagtattgaagaacaacaaaaacctctgacagattcccaaagggtaaagtttaccaaagaaattaaaggtctaaaggtggagataacgcactgtgggcagatgaagaggaagtaccgcgtctgcaatgtgacccggcggcccgccagtcaccaaacattcccgctgcagcaggagagcgggcagacggtggagtgcacggtggcccagtatttcaaggacaggcacaagttggttctgcgctacccccacctcccatgtttacaagtcggacaggagcagaaacacacctaccttcccctggaggtctgtaacattgtggcaggacaaagatgtattaaaaaattaacggacaatcagacctcaaccatgatcagagcgactgctaggtcggcgcccgatcggcaagaagagattagcaaattgatgcgaagtgcaagtttcaacacagatccatacgtccgtgaatttggaatcatggtcaaagatgagatgacagacgtgactgggcgggtgctgcagccgccctccatcctctacgggggcaggaataaagctattgcgacccctgtccagggcgtctgggacatgcggaacaagcagttccacacgggcatcgagatcaaggtgtgggccattgcgtgcttcgccccccagcgccagtgcacggaagtccatctgaagtccttcacagagcagctcagaaagatctcgagagacgccggcatgcccatccagggccagccgtgcttctgcaaatacgcgcagggggcggacagcgtggagcccatgttccggcacctgaagaacacgtatgcgggcctgcagctggtggtggtcatcctgcccggcaagacgcccgtgtacgccgaggtcaagcgcgtgggagacacggtgctggggatggccacgcagtgcgtgcagatgaagaacgtgcagaggaccacgccacagaccctgtccaacctctgcctgaagatcaacgtcaagctgggaggcgtgaacaacatcctgctgccccagggcaggccgccggtgttccagcagcccgtcatctttctgggagcagacgtcactcacccccccgccggggatgggaagaagccctccattgccgccgtggtgggcagcatggacgcccaccccaatcgctactgcgccaccgtgcgcgtgcagcagcaccggcaggagatcatacaagacctggccgccatggtccgcgagctcctcatccagttctacaagtccacgcgcttcaagcccacccgcatcatcttctaccgcgacggtgtctctgaaggccagttccagcaggttctccaccacgagttgctggccatccgtgaggcctgtatcaagctagaaaaagactaccagcccgggatcaccttcatcgtggtgcagaagaggcaccacacccggctcttctgcactgacaagaacgagcgggttgggaaaagtggaaacattccagcaggcacgactgtggacacgaaaatcacccaccccaccgagttcgacttctacctgtgtagtcacgctggcatccaggggacaagcaggccttcgcactatcacgtcctctgggacgacaatcgtttctcctctgatgagctgcagatcctaacctaccagctgtgtcacacctacgtgcgctgcacacgctccgtgtccatcccagcgccagcatactacgctcacctggtggccttccgggccaggtaccacctggtggataaggaacatgacagtgctgaaggaagccatacctctgggcagagtaacgggcgagaccaccaagcactggccaaggcggtccaggttcaccaagacactctgcgcaccatgtactttgcttgacatgttttagtgtttagcgattgtgtaccgagtgggattcacgagaccagctacactcagaccaacagatggccagcccttccgtgacagccagcatcgaacatgagacgtcattgattttattagattctccgttttccagaatgccttccgtcccagatttcaaacttggattttgaactgcagacctgtatgagaacccaatgtcataggaaatatggtttgctaaaatctataagctgcttattaaaacagagtcccgtgtgtcctaaaaatctcctaaaaccagtctatgaactcagggctttaaaacatttttaatttatttggtcattcaatttacttgtttttaatacatgattctctatgaaattgatgggctcaaactagctgtgaatcttctgagagtgaaagcaacacaaaacacaagtgtggttttaaagccttgaacattctgatgttgtcactaaagttgatttccaggcgatgctcgtgtgcccctggcgtggctcacccaagttcctcgactgagggccggtggccatgcagaggcgtccgcaggtgccgtgttctgccagcaccgcccttcacccggcctgaactaaggagcagtggcagaaggtgggccccgtgtgtttacagcatttccaggtccagagaggttggcagacaagtgccattttaataaaaaatgtatttaaaaaaagaaaaaagacaatatactgacagtctaatcatcagatttgtcctataggactgtgacatttattttccaaagtttttaaagaatacgggtctgtggtgataaatacagtacaatcctttttcactgttatgtctttaatgtaagagaagaatatatatatctggtttgcagta

SEQ ID NO: 10031 - DNA, 3141 bp, Homo sapiens
cggccgcccctcggccccggagcccctcggcggcgccaccatgtactcgggagccggccccgcacttgcacctcctgcgccgccgccccccatccaaggatatgccttcaagcctccacctagacccgactttgggacctccgggagaacaatcaaattacaggccaatttcttcgaaatggacatccccaaaattgacatctatcattatgaattggatatcaagccagagaagtgcccgaggagagttaacagggaaatcgtggaacacatggtccagcactttaaaacacagatctttggggatcggaagcccgtgtttgacggcaggaagaatctatacacagccatgccccttccgattgggagggacaaggtggagctggaggtcacgctgccaggagaaggcaaggatcgcatcttcaaggtgtccatcaagtgggtgtcctgcgtgagcttgcaggcgttacacgatgcactttcagggcggctgcccagcgtcccttttgagacgatccaggccctggacgtggtcatgaggcacttgccatccatgaggtacacccccgtgggccgctccttcttcaccgcgtccgaaggctgctctaaccctcttggcgggggccgagaagtgtggtttggcttccatcagtccgtccggccttctctctggaaaatgatgctgaatattgatgtgtcagcaacagcgttttacaaggcacagccagtaatcgagtttgtttgtgaagttttggattttaaaagtattgaagaacaacaaaaacctctgacagattcccaaagggtaaagtttaccaaagaaattaaaggtctaaaggtggagataacgcactgtgggcagatgaagaggaagtaccgcgtctgcaatgtgacccggcggcccgccagtcaccaaacattcccgctgcagcaggagagcgggcagacggtggagtgcacggtggcccagtatttcaaggacaggcacaagttggttctgcgctacccccacctcccatgtttacaagtcggacaggagcagaaacacacctaccttcccctggaggtctgtaacattgtggcaggacaaagatgtattaaaaaattaacggacaatcagacctcaaccatgatcagagcgactgctaggtcggcgcccgatcggcaagaagagattagcaaattgatgcgaagtgcaagtttcaacacagatccatacgtccgtgaatttggaatcatggtcaaagatgagatgacagacgtgactgggcgggtgctgcagccgccctccatcctctacgggggcaggaataaagctattgcgacccctgtccagggcgtctgggacatgcggaacaagcagttccacacgggcatcgagatcaaggtgtgggccattgcgtgcttcgccccccagcgccagtgcacggaagtccatctgaagtccttcacagagcagctcagaaagatctcgagagacgccggcatgcccatccagggccagccgtgcttctgcaaatacgcgcagggggcggacagcgtggagcccatgttccggcacctgaagaacacgtatgcgggcctgcagctggtggtggtcatcctgcccggcaagacgcccgtgtacgccgaggtcaagcgcgtgggagacacggtgctggggatggccacgcagtgcgtgcagatgaagaacgtgcagaggaccacgccacagaccctgtccaacctctgcctgaagatcaacgtcaagctgggaggcgtgaacaacatcctgctgccccagggcaggccgccggtgttccagcagcccgtcatctttctgggagcagacgtcactcacccccccgccggggatgggaagaagccctccattgccgccgtggtgggcagcatggacgcccaccccaatcgctactgcgccaccgtgcgcgtgcagcagcaccggcaggagatcatacaagacctggccgccatggtccgcgagctcctcatccagttctacaagtccacgcgcttcaagcccacccgcatcatcttctaccgcgacggtgtctctgaaggccagttccagcaggttctccaccacgagttgctggccatccgtgaggcctgtatcaagctagaaaaagactaccagcccgggatcaccttcatcgtggtgcagaagaggcaccacacccggctcttctgcactgacaagaacgagcgggggacaagcaggccttcgcactatcacgtcctctgggacgacaatcgtttctcctctgatgagctgcagatcctaacctaccagctgtgtcacacctacgtgcgctgcacacgctccgtgtccatcccagcgccagcatactacgctcacctggtggccttccgggccaggtaccacctggtggataaggaacatgacagtgctgaaggaagccatacctctgggcagagtaacgggcgagaccaccaagcactggccaaggcggtccaggttcaccaagacactctgcgcaccatgtactttgcttgacatgttttagtgtttagcgattgtgtaccgagtgggattcacgagaccagctacactcagaccaacagatggccagcccttccgtgacagccagcatcgaacatgagacgtcattgattttattagattctccgttttccagaatgccttccgtcccagatttcaaacttggattttgaactgcagacctgtatgagaacccaatgtcataggaaatatggtttgctaaaatctataagctgcttattaaaacagagtcccgtgtgtcctaaaaatctcctaaaaccagtctatgaactcagggctttaaaacatttttaatttatttggtcattcaatttacttgtttttaatacatgattctctatgaaattgatgggctcaaactagctgtgaatcttctgagagtgaaagcaacacaaaacacaagtgtggttttaaagccttgaacattctgatgttgtcactaaagttgatttccaggcgatgctcgtgtgcccctggcgtggctcacccaagttcctcgactgagggccggtggccatgcagaggcgtccgcaggtgccgtgttctgccagcaccgcccttcacccggcctgaactaaggagcagtggcagaaggt

SEQ ID NO: 10032 - DNA, 3211 bp, Homo sapiens
ccggcccagagctttcggagtgcggttgctcaggggaagccgtcgccgcccccgcctcggggccgagtgagagtgcccgtcgcgtcgcgccgcgtcgccccccgggccgcctccttgccgccagtggcgggctccgttctccctcgaagcactccccccagctccatgaatggaaatcggctccgcaggacccgctggggcccagcccctactcatggtgcccagaagacctggctatggcaccatgggcaaacccattaaactgctggctaactgttttcaagttgaaatcccaaagattgatgtctacctctatgaggtagatattaaaccagacaagtgtcctaggagagtgaacaggtagatttagacgttactttacctggggaaggtggaaaagatcgacctttcaaggtgtcaatcaaatttgtctctcgggtgagttggcacctactgcatgaagtactgacaggacggaccttgcctgagccactggaattagacaagccaatcagcactaaccctgtccatgccgttgatgtggtgctacgacatctgccctccatgaatttctgccactgccttctacaaagcacaacctgtaattcagttcatgtgtgaagttcttgatattcataatattgatgagcaaccaagacctctgactgattctcatcgggtaaaattcaccaaagagataaaaggtttgaaggttgaagtgactcattgtggaacaatgagacggaaataccgtgtttgtaatgtaacaaggaggcctgccagtcatcaaacctttcctttacagttagaaaacggccaaactgtggagagaacagtagcgcagtatttcagagaaaagtatactcttcagctgaagtacccgcaccttccctgtctgcaagtcgggcaggaacagaaacacacctacctgccactagaagtctgtaatattgtggcagggcaacgatgtatcaagaagctaacagacaatcagacttccactatgatcaaggcaacagcaagatctgcaccagatagacaagaggaaattagcagattggtaagaagtgcaaattatgaaacagatccatttgttcaggagtttcaatttaaagttcgggatgaaatggctcatgtaactggacgcgtacttccagcacctatgctccagtatggaggacggaatcggacagtagcaacaccgagccatggagtatgggacatgcgagggaaacaattccacacaggagttgaaatcaaaatgtgggctatcgcttgttttgccacacagaggcagtgcagagaagaaatattgaagggtttcacagaccagctgcgtaagatttctaaggatgcagggatgcccatccagggccagccatgcttctgcaaatatgcacagggggcagacagcgtagagcccatgttccggcatctcaagaacacatattctggcctacagcttattatcgtcatcctgccggggaagacaccagtgtatgcggaagtgaaacgtgtaggagacacacttttgggtatggctacacaatgtgttcaagtcaagaatgtaataaaaacatctcctcaaactctgtcaaacttgtgcctaaagataaatgttaaactcggagggatcaataatattcttgtacctcatcaaagaccttctgtgttccagcaaccagtgatctttttgggagccgatgtcactcatccacctgctggtgatggaaagaagccttctattgctgctgttgtaggtagtatggatgcacacccaagcagatactgtgccacagtaagagttcagagaccccgacaggagatcatccaggacttggcctccatggtccgggaacttcttattcaattttataagtcaactcggttcaagcctactcgtatcatcttttatcgggatggtgtttcagaggggcagtttaggcaggtattatattatgaactactagcaattcgagaagcctgcatcagtttggagaaagactatcaacctggaataacctacattgtagttcagaagagacatcacactcgattattttgtgctgataggacagaaagggttggaagaagtggcaatatcccagctggaacaacagttgatacagacattacacacccatatgagttcgatttttacctctgtagccatgctggaatacagggtaccagtcgtccttcacactatcatgttttatgggatgataactgctttactgcagatgaacttcagctgctaacttaccagctctgccacacttacgtacgctgtacacgatctgtttctatacctgcaccagcgtattatgctcacctggtagcatttagagccagatatcatcttgtggacaaagaacatgacagtgctgaaggaagtcacgtttcaggacaaagcaatgggcgagatccacaagctcttgccaaggctgtacagattcaccaagataccttacgcacaatgtacttcgcttaaatagtccaagtatattctctgagaggaagtactgaaagatgaattgacatacaacgtatgtttccagtgaagtcaattgagtaaggacacctccagccatacagaaaccaacactgtgtgggggccaaggtctgatccttatgttaatacaaggaagattgtttacttcatcaaggaacacagcatcattatgcaatatgaaaccagccaactgctttttgtgcggtctcctataggaagtatcgcaattgttttgttttcatttcttgtagtctaacccttttaatgcctttacctcaagttgcttggcagcacaactatctttgcaaaaaaaagtaaagaaaaagtaaatgatggtttaaaaaatacacaccttcatgaataatcaaagtgatttttcagaattatgtgtgcaaaaaattaatgtgcattcatatattcttgtaaaaggtgtctgtgtatttttaaaatatatacatccatacttcatatgcatatatatctagatctggattgataatagatatatatgtgtctgttatatattttagagttcattccattggggaattttctttcccttttattctacccccactaccgcctttatttctctatttcccttgccttcatcacctacatttttttcccagtcctaccagtgacattcaaatgttgatgtatctggttcgtttgaatataaaatatggcaaacta

SEQ ID NO: 10033 - DNA, 1726 bp, Homo sapiens
aggaaggagggtggccctaccccagcgggctcggctcggggcctccgcggcagttcggggtccttcacccgccggctccagtcctgtgccgttttccgtccgcgactcttccggcccagagctttcggagtgcggttgctcaggggaagccgtcgccgcccccgcctcggggccgagtgagagtgcccgtcgcgtcgcgccgcgtcgccccccgggccgcctccttgccgccagtggcgggctccgttctccctcgaagcactccccccagctccatgaatggaaatcggctccgcaggacccgctggggcccagcccctactcatggtgcccagaagacctggctatggcaccatgggcaaacccattaaactgctggctaactgttttcaagttgaaatcccaaagattgatgtctacctctatgaggtagatattaaaccagacaagtgtcctaggagagtgaacagggaggtggttgactcaatggttcagcattttaaagtaactatatttggagaccgtagaccagtttatgatggaaaaagaagtctttacaccgccaatccacttcctgtggcaactacaggggtagatttagacgttactttacctggggaaggtggaaaagatcgacctttcaaggtgtcaatcaaatttgtctctcgggtgagttggcacctactgcatgaagtactgacaggacggaccttgcctgagccactggaattagacaagccaatcagcactaaccctgtccatgccgttgatgtggtgctacgacatctgccctccatgaaatacacacctgtggggcgttcatttttctccgctccagaaggatatgaccaccctctgggagggggcagggaagtgtggtttggattccatcagtctgttcggcctgccatgtggaaaatgatgcttaatatcgatgaaagagacctctggcagcagtgtggagaatagatagaggagaaaaaactaatctgagaagccagttaggaggcttttcaatcactagttcaggtaagagatggtgatggtctaatgtgggatggagaggaaggattaagctgaaaaaataggtttaagaaccatgtccagaaaaaaaaaactttgggtgtagtactggtacatggaacggattggaaaaaaatagaccagagctttactagatttttgaaagaattgtttttgcaaataaactacaagcctggcatatcagtcaaggttcagaacctagagaagcagaaccagtacgaagtatagagagagagtttatgcaattgtaggggctagctaggcaagtctgaaattttgggggcaggctgtcaggaagggcagggaaattcaggcatgggctgaagcagttatctataagtggaatttcttgctctcagggaagcttcagccctacttttaagacctttcacctaattgaatcaggcccatccacattattcaggataatctccattacttaaagtcaacagattatggattttaattacatctacaaaataccttcatagcaacacctagattagtgtttgattaaacaaatggcagctggtagcctagcaagttaacacattaaaaacaacacctgccatgatggcttacacttgtaatcccagcactttgggaggccaaagtgggaggatcacttgagattaggagtttgcgatcaggctgaacaacatagtgagacctgatctctacc

SEQ ID NO: 10034 - DNA, 3649 bp, Homo sapiens
cggcgagcttccggggcggccccgggcaggtcggcggcggcggcccgcagtcgtggaggagcggtgggagcgtcggcggccgcgggcgatgcaacttccggacgggactcccctctgtccgcgcctcacatctccccttcctctcgcctagtcctgtgccgttttccgtccgcgactcttccggcccagagctttcggagtgcggttgctcaggggaagccgtcgccgcccccgcctcggggccgagtgagagtgcccgtcgcgtcgcgccgcgtcgccccccgggccgcctccttgccgccagtggcgggctccgttctccctcgaagcactccccccagctccatgaatggaaatcggctccgcaggacccgctggggcccagcccctactcatggtgcccagaagacctggctatggcaccatgggcaaacccattaaactgctggctaactgttttcaagttgaaatcccaaagattgatgtctacctctatgaggtagatattaaaccagacaagtgtcctaggagagtgaacagggaggtggttgactcaatggttcagcattttaaagtaactatatttggagaccgtagaccagtttatgatggaaaaagaagtctttacaccgccaatccacttcctgtggcaactacaggggtagatttagacgttactttacctggggaaggtggaaaagatcgacctttcaaggtgtcaatcaaatttgtctctcgggtgagttggcacctactgcatgaagtactgacaggacggaccttgcctgagccactggaattagacaagccaatcagcactaaccctgtccatgccgttgatgtggtgctacgacatctgccctccatgaaatacacacctgtggggcgttcatttttctccgctccagaaggatatgaccaccctctgggagggggcagggaagtgtggtttggattccatcagtctgttcggcctgccatgtggaaaatgatgcttaatatcgatgtttctgccactgccttctacaaagcacaacctgtaattcagttcatgtgtgaagttcttgatattcataatattgatgagcaaccaagacctctgactgattctcatcgggtaaaattcaccaaagagataaaaggtttgaaggttgaagtgactcattgtggaacaatgagacggaaataccgtgtttgtaatgtaacaaggaggcctgccagtcatcaaacctttcctttacagttagaaaacggccaaactgtggagagaacagtagcgcagtatttcagagaaaagtatactcttcagctgaagtacccgcaccttccctgtctgcaagtcgggcaggaacagaaacacacctacctgccactagaagtctgtaatattgtggcagggcaacgatgtatcaagaagctaacagacaatcagacttccactatgatcaaggcaacagcaagatctgcaccagatagacaagaggaaattagcagattggtaagaagtgcaaattatgaaacagatccatttgttcaggagtttcaatttaaagttcgggatgaaatggctcatgtaactggacgcgtacttccagcacctatgctccagtatggaggacggaatcggacagtagcaacaccgagccatggagtatgggacatgcgagggaaacaattccacacaggagttgaaatcaaaatgtgggctatcgcttgttttgccacacagaggcagtgcagagaagaaatattgaagggtttcacagaccagctgcgtaagatttctaaggatgcagggatgcccatccagggccagccatgcttctgcaaatatgcacagggggcagacagcgtagagcccatgttccggcatctcaagaacacatattctggcctacagcttattatcgtcatcctgccggggaagacaccagtgtatgcggaagtgaaacgtgtaggagacacacttttgggtatggctacacaatgtgttcaagtcaagaatgtaataaaaacatctcctcaaactctgtcaaacttgtgcctaaagataaatgttaaactcggagggatcaataatattcttgtacctcatcaaagaccttctgtgttccagcaaccagtgatctttttgggagccgatgtcactcatccacctgctggtgatggaaagaagccttctattgctgctgttgtaggtagtatggatgcacacccaagcagatactgtgccacagtaagagttcagagaccccgacaggagatcatccaggacttggcctccatggtccgggaacttcttattcaattttataagtcaactcggttcaagcctactcgtatcatcttttatcgggatggtgtttcagaggggcagtttaggcaggtattatattatgaactactagcaattcgagaagcctgcatcagtttggagaaagactatcaacctggaataacctacattgtagttcagaagagacatcacactcgattattttgtgctgataggacagaaagggttggaagaagtggcaatatcccagctggaacaacagttgatacagacattacacacccatatgagttcgatttttacctctgtagccatgctggaatacagggtaccagtcgtccttcacactatcatgttttatgggatgataactgctttactgcagatgaacttcagctgctaacttaccagctctgccacacttacgtacgctgtacacgatctgtttctatacctgcaccagcgtattatgctcacctggtagcatttagagccagatatcatcttgtggacaaagaacatgacagtgctgaaggaagtcacgtttcaggacaaagcaatgggcgagatccacaagctcttgccaaggctgtacagattcaccaagataccttacgcacaatgtacttcgcttaaatagtccaagtatattctctgagaggaagtactgaaagatgaattgacatacaacgtatgtttccagtgaagtcaattgagtaaggacacctccagccatacagaaaccaacactgtgtgggggccaaggtctgatccttatgttaatacaaggaagattgtttacttcatcaaggaacacagcatcattatgcaatatgaaaccagccaactgctttttgtgcggtctcctataggaagtatcgcaattgttttgttttcatttcttgtagtctaacccttttaatgcctttacctcaagttgcttggcagcacaactatctttgcaaaaaaaagtaaagaaaaagtaaatgatggtttaaaaaatacacaccttcatgaataatcaaagtgatttttcagaattatgtgtgcaaaaaattaatgtgcattcatatattcttgtaaaaggtgtctgtgtatttttaaaatatatacatccatacttcatatgcatatatatctagatctggattgataatagatatatatgtgtctgttatatattttagagttcattccattggggaattttctttcccttttattctacccccactaccgcctttatttctctatttcccttgccttcatcacctacatttttttcccagtcctaccagtgacattcaaatgttgatgtatctggttcgtttgaatataaaatatggcaaacta

SEQ ID NO: 10035 - DNA, 1404 bp, Homo sapiens
gagcttccggggcggccccgggcaggtcggcggcggcggcccgcagtcgtggaggagcggtgggagcgtcggcggccgcgggcgatgcaacttccggacgggactcccctctgtccgcgcctcacatctccccttcctctcgcctagtcctgtgccgttttccgtccgcgactcttccggcccagagctttcggagtgcggttgctcaggggaagccgtcgccgcccccgcctcggggccgagtgagagtgcccgtcgcgtcgcgccgcgtcgccccccgggccgcctccttgccgccagtggcgggctccgttctccctcgaagcactccccccagctccatgaatggaaatcggctccgcaggacccgctggggcccagcccctactcatggtgcccagaagacctggctatggcaccatgggcaaacccattaaactgctggctaactgttttcaagttgaaatcccaaagattgatgtctacctctatgaggtagatattaaaccagacaagtgtcctaggagagtgaacagggaggtggttgactcaatggttcagcattttaaagtaactatatttggagaccgtagaccagtttatgatggaaaaagaagtctttacaccgccaatccacttcctgtggcaactacaggggtagatttagacgttactttacctggggaaggtggaaaagatcgacctttcaaggtgtcaatcaaatttgtctctcgggtgagttggcacctactgcatgaagtactgacaggacggaccttgcctgagccactggaattagacaagccaatcagcactaaccctgtccatgccgttgatgtggtgctacgacatctgccctccatgaaatacacacctgtggggcgttcatttttctccgctccagaaggatatgaccaccctctgggagggggcagggaagtgtggtttggattccatcagtctgttcggcctgccatgtggaaaatgatgcttaatatcgatgaaagagacctctggcagcagtgtggagaatagatagaggagaaaaaactaatctgagaagccagttaggaggcttttcaatcactagttcaggtttcagtctacatgttacttccttgagaagcagtgtttgacacccttctcccccaatccagccatcccccaagtctgagttaggtatttctcttctgtattcccatagcacagtgtaattcccctataatagcatgtatcaccttgaattatgggtgtttattgttctgtctctcctgttagaacgaaagctccatgaagggattgtcattttattcaccagtgtaccctctatgcccagcacaacttttggtcatattaaacaaagaatgaataaataaatccaagagcataggaggaggagcatcc

SEQ ID NO: 10036 - DNA, 7116 bp, Homo sapiens
gcggcggcggcggcggcggcggcggggattgtttttgttgtcgctgaggccggaagagccggagccgggtccctgtccccgggccgggcgccgccgccgccccctgcccagcgcccgcgtctccgcggcgccaccccagcgccaatattccggagatcaagcgttacgcggcggcggcggcggcggcggcggggcccggagcgggaggcgccggggaccggggcgaggcggcccccgccgccgccatggaggcgctgggacccggacctccggctagcctgtttcagccacctcgtcgtcctggccttggaactgttggaaaaccaattcgactgttagccaatcattttcaggttcagattcctaaaatagatgtgtatcactatgatgtggatattaagcctgaaaaacggcctcgtagagtcaacagggaggtagtagatacaatggtgcggcacttcaagatgcaaatatttggtgatcggcagcctgggtatgatggcaaaagaaacatgtacacagcacatccactaccaattggacgggatagggttgatatggaggtgactcttccaggcgagggtaaagaccaaacatttaaagtgtctgttcagtgggtgtcagttgtgagccttcagttgcttttagaagctttggctgggcacttgaatgaagtcccagatgactcagtacaagcacttgatgttatcacaagacaccttccctccatgaggtacaccccagtgggccgttcctttttctcacccccggaaggttactaccaccctctgggagggggcagggaggtctggtttggttttcatcagtctgtgagacctgccatgtggaatatgatgctcaacattgatgtatctgcaactgctttctaccgggctcagcctatcattgagttcatgtgtgaggttttagacattcagaacatcaatgaacagaccaaacctctaacagactcccagcgtgtcaaatttaccaaagaaatcagaggtctcaaagttgaggtgacccactgtggacagatgaaacgaaaataccgagtttgtaatgtgactagacggccagccagtcatcaaacttttcctttgcagctagaaaacggtcaagctatggaatgtacagtagctcaatattttaagcaaaagtatagtctgcaactgaaatacccccatcttccctgtctccaagtgggacaagaacaaaagcatacatacttgccactcgaggtctgtaatatagtggcaggacagcgatgtatcaagaagctcacagacaatcagacttccacaatgatcaaagctacagcaagatctgctcctgacagacaggaagagatcagtagactggtgaagagcaacagtatggtgggtggacctgatccataccttaaagaatttggtattgttgtccacaatgaaatgacagagctcacaggcagggtacttccagcaccaatgctgcaatatggaggccggaataaaacagtagccacacccaaccagggtgtctgggacatgcgaggaaagcagttttatgctggcattgaaattaaagtttgggcagttgcttgttttgcacctcagaaacaatgtagggaagatttactaaagagtttcactgaccagctgcgtaaaatctctaaggatgcaggaatgcccatccagggtcagccatgtttctgcaagtatgcacaaggtgcagacagtgtggagcctatgtttaaacatctgaaaatgacttatgtgggcctacagctaatagtggttatcctgcctggaaagacaccagtatatgcggaggtgaaacgtgttggagatacccttctaggtatggccacacagtgtgtccaggtaaaaaatgtagtgaagacctcacctcaaaccctttccaatctttgcctgaagataaatgcaaaacttggaggaattaacaatgtgcttgtgcctcatcaaaggccctcggtgttccagcagcctgtcatcttcctgggagcggatgtcacacaccccccagcaggggatgggaagaaaccttccattgctgctgtggttggcagtatggatggccaccccagccggtactgtgccaccgttcgggtgcagacttcccggcaggagatctcccaagagctcctctacagtcaagaggtcatccaggacctgactaacatggttcgagagctgctgattcagttctacaaatccacacgcttcaaacccactcggatcatctattaccgtggaggggtatctgagggacaaatgaaacaggtagcttggccagaactaatagcaattcgaaaggcatgtattagcttggaagaagattaccggccaggaataacttatattgtggtgcaaaaaagacatcacacacgactcttctgtgcagataaaacagaaagggtagggaaaagtggcaatgtaccagcaggcactacagtggatagtaccatcacacatccatctgagtttgacttttacctctgtagtcatgcaggaattcagggaaccagccgtccctcacattaccaggtcttgtgggatgacaactgcttcactgcagatgaactccagctactgacttaccagctgtgtcacacctatgtgaggtgcactcgctcagtctctattccagcccctgcatattatgcccggcttgtagcatttagggcaaggtatcatctggtggataaagatcatgacagtgcggaaggcagtcatgtgtcaggacagagcaacggccgggatcctcaggccttggctaaggctgtgcaaatccaccatgatacccagcacacgatgtattttgcctgagagtctcagaaaaagaactcaaccaatttggcaccccatgcagcctcaaaatgtttcaaatgcctaccgcctctagatcgagccacgttgacttcaggtggtcttctaccagcagctcggaatagttgcactgaatctatactttgcagcactgtctgatgcgtcaacaaaattgagccatttttttaaagtaatagatactaatagattatcttttctgatgcactggactgaatttttacctcaatgtgcaaaggctgatcagcctgaactttctaaaggactttacaagaagggtttctatggaatattttgctagctgtggtgttcaccgcatccctctagtcttagaagagaagattattccttttttctgtagtcattgagtggggtatatgcataagtgggagagaaaaaccaaacaatctacttcagttcagtgtaactatttaattgtgtgggtccatagactttttaatgaagatttctgactttgccactgtaaatgcctttaatgagcattaatttttgaaagttttacagagttttattagttttactactttatcttattgatctctgcagacttgtgctggtgcaagtacatgctgacaggcaatttgcactatatttggctgcagattcaaataggcagttctcttatttggtcgacttttgtgaatgtgtgacataaacagatgtaatgcatgtcacagtgacggagataacactgccatgataaaagtactcatgtttcccctatttggaaaaaaaaattgcttttagtatttttccaagttttcaaaagtgcccattttatgctgctgtgtggtttgttaaatctaaatgatttttaaacttttctcatagaaacttaactttggcaataaacattttttaaggtctctcctcttccttccccaacaatgtagttttctagatgagatttcagtatgattttatcagctatttcttatatatcataatctggcaatttctgaaaccagtcagaaaagacatatatttccatgcctttttaaagaattatttttacctgttttatattcacagttggtgtcctgtcactttgttttaaaataagctagaaccaggatgcttccttattggaaaggctttgccagtccttaaggtacaatgagtgatgctgcaacttgcaaatgtaccagcatttaaaatttcttttcctgggaatcaaggtaactcacacgactacttgcagtacaaattttttgcttctctttcgacatgaaatgtacttggtgggttttccttccttttattaaactaaaactgtgtggaaaaggttgatttttcttaatagattctggattccactcacagggagatgggattcctttcttgtccaaacaaagggagttgctctaaagcgagcatcagttaaaatgtaggggaaaatgtattctgtatgtagtgtagataatactttgtgaatggacaacagttacatagtgtcttggtagcaccagccagtgtttcccagcccagagtttactgacttgtaattctctatccaggacatcaggagtgagggatggaaaaggggataaaaggcctggagccacactctatatggctgaggaaggagctagggaaagagatagacacaatggggtgaaaacaattttgccgcccctgcctggaaactgctggtggggaaatgatggtgaagggtgtttgcttgaactcatgagacggtccaaatctcataaactagccttctcaaaatcccagcaatataaagcactgtttttcttcagtcgtttaaataaacttgtaaatacattgaagtttacatttccatgtgctgttgatcaacggcgccacctgtgtttgctgagactggtctctgagagagttttatgtcgatcgaggcctgttgctcattaagctgagtgcagacgtccttaatccctgcagatagtgggatgaaagcaagttctgtaaaatgaagcacaacatagccaggagtgaagagatggcagatgttaatttcttaaaattttccttttttttttttttttttgcaaatacctcacttggataatacaaatcaggacatgttggtgaggggctggctgcttggctgctgcttttattcacacttgttcagggagagcacagagaatacccttcagcatggccactctggacccaagaggaggaaaaaacggaagcttttttaggagaaggaggacttgctggaatccaagatgtgaagaactcttggtgactggctggctggccagcgggcaccacacctgcacttgagtgcctcgggcttgcttattaataacgcacagaagaagcatcacttctcaccatctcctggcatgtatggagcagggagcaaggctatgttcccgaaagccctgattagcttgtcttgctctacgctcgacctcgaacaatacagcttgtaagacctcagtcagtcctggtacactggggtaaatcagtgtggtggtggaagaaaagccgggaggcctatttttataggaaaatagtaccattaaaggtgcaatgctgtcattttggacaaaaggaaagaaatttggaagagctgggattattggcaaaaacttgctgaggggtgaatctttagagctaatcactgcagaatcagagttgcagcaatatgattgcaagcaagtctgaatgcatagttttactttaattcggcttgacaatttgaataggtaaccccctcgggactgactgaatcgttatgcatgtgtcaatcaatgggaggtgtgcattctctagaagtagttttaggctgtttggtttggttttggttttgttttttaaatgcagcctgttgaggcactgtcatgtggtgtgaaagatttaaatgtagcaacgctaaagagtaataatttggggataagaagtggggacattggccgggcgcggtggctcacgcctgtaattccagcactttgggaggcctaggtgggcggatcagctgaggtcgagagttcgaggccagtctgaccaacatggtgaaaccccatctctactaaaaatacagaaaattagctgggtctggtggtggatgcctgtaatcccagctactcgggaggctgaggcaggagaattgcttgaacccaggaggtggacggtgcagtgagctattactccagcctgggcaacaagagcgaaactctgtctcaaaaaaaaaaaggggggggggggacattaagagagtggtgatgacccaaatgttgaaccaattatgttttggtggtggtgttcttagctgttgaatcctgaatggtttataaagtgaactagctggcttaatgcagccagcgttctgggcagcagaacatattcattcttactgtaaattctatttgctgcttccaaaggtgatgattttcaagcagacatgttctatatggtctgtgttttaggatctggtgcccagcctctatcagagcttgcctacctggcaaagctgcctacccttcaagtgggaaaatataatccactgtttaacaaggctcaccctctccaccctgtcctaacgaccttttgtgaatgtgctgtgatattttcttgctcaatagcaaggtggtagctctgctttcattttaagaaagtggaggctgagggcattgtatcaatactgttgcaactccaagaagttttccttgtaaaattaaaggaaagatcttgttattgattaaccattttcttatgccttgctattgacatattcatgctctttctacgtctagtggctgaaaatgtttgcatttgttcatttgactaatggtgtgatttttgtttctatattattagacctgtaatgttttaaaatgtattttattaaatttggactggatgtatgtctctagcaatacgaggtactttctaaactattaagggaggggttgtatcctcatgttgagataagatgatggtcgtttaaattttgcaattttttttggcctgcagggatattttgtgtttatgtgtccaaaaaaggaataaattggcattcttgtgccaaaagttgtttttcctgtcaattgtctaataagtatgcagtacactgtaatggcaacatacatggttgctttataaaaacagtttcctcagtatgagaaattttacaaagaacagtggaaaaactttgtgtttttaactcttgggtctccctatttttaaaaattgctatttggtatacaattattatgtgtcaattaaaactaaaataaaacttttaaaaaagaaa

SEQ ID NO: 10037 - DNA, 2094 bp, Homo sapiens
agttccaggtaccgccactgggggcggccgcggcctccccagcggcaacggccacgaagctgcgcggccctggtttccagccgggcccttttcgcggccgggccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagtgtacacgctgtggtcctatcctgatcttctgccaacctttacaacatggcctctggtgctcgagaaactggtagggggagcagatttgatgctgcctggactggtgatgccccctgctggtctgcctcaggtacagaagggcgacctctgtgccatttctttggtggggaacagagcccctgtagccattggagttgcagccatgtccacagctgagatgctcacgtcaggcctgaagggaaggggcttctctgtgctccacacttaccaggaccacttgtggcggtctggaaacaagtcctctccaccttccattgctccactggccctggattcagcagatctcagtgaagagaaggggtctgtccagatggactccaccctgcagggagacatgaggcacatgaccctggagggggaagaggagaatggggaggttcaccaggcacgtgaagacaagtctctctcagaagccccagaagacaccagcaccaggggcctgaaccaagactccacagatagcaaaacgcttcaagaacaaatggatgagctgttacagcaatgcttcttacatgccttgaagtgccgagtcaaaaaggctgacctccctttactcaccagcactttccttggcagccacatgttctcctgctgccctgaaggacgacaactggacataaagaagtcaagctacaaaaagctctctaagttcctgcagcaaatgcagcaggagcagattatacaggtgaaggagctgagcaaaggggtggagagcattgtggctgtggactggaaacacccgaggattacatctttcgtcatacccgagccctccccgacctcccagactatccaggagggtagcagggaacagccctatcaccctccagatataaaacccctctactgtgtcccagccagcatgaccctgctcttccaggagtctggccacaagaaggggagctttctggagggcagtgaggtccgaacgatcgtcattaactacgccaagaaaaatgacctggttgatgcagacaacaaaaatcttgtgagattggatcccatcctatgtgactgcatcttagagaaaaatgaacagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaaggtgaccgtggtccggaacttggaggcctatggtctggacccatactcagtggctgccatccttcagcagcgatgccaggctagcaccaccgtcaatcctgcccctggggccaaggacagccttcaggtgcagatccagggaaaccaggtccaccacctcggctggctattgcttgaagagtatcagctccctcgaaaacacatccaaggtctagaaaaggccctcaaacctggcaagaagaagtgacagactcttttgtctcacgtggtggatccggtggaaatccaagctctgggctggtaatttttatgagcattttcagcttttgcaaatacaaaatataattctttacaaaaataaatttttattctaatct

SEQ ID NO: 10038 - DNA, 1923 bp, Homo sapiens
cttttcgcggccgggccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagatttgatgctgcctggactggtgatgccccctgctggtctgcctcaggtacagaagggcgacctctgtgccatttctttggtggggaacagagcccctgtagccattggagttgcagccatgtccacagctgagatgctcacgtcaggcctgaagggaaggggcttctctgtgctccacacttaccaggaccacttgtggcggtctggaaacaagtcctctccaccttccattgctccactggccctggattcagcagatctcagtgaagagaaggggtctgtccagatggactccaccctgcagggagacatgaggcacatgaccctggagggggaagaggagaatggggaggttcaccaggcacgtgaagacaagtctctctcagaagccccagaagacaccagcaccaggggcctgaaccaagactccacagatagcaaaacgcttcaagaacaaatggatgagctgttacagcaatgcttcttacatgccttgaagtgccgagtcaaaaaggctgacctccctttactcaccagcactttccttggcagccacatgttctcctgctgccctgaaggacgacaactggacataaagaagtcaagctacaaaaagctctctaagttcctgcagcaaatgcagcaggagcagattatacaggtgaaggagctgagcaaaggggtggagagcattgtggctgtggactggaaacacccgaggattacatctttcgtcatacccgagccctccccgacctcccagactatccaggagggtagcagggaacagccctatcaccctccagatataaaacccctctactgtgtcccagccagcatgaccctgctcttccaggagtctggccacaagaaggggagctttctggagggcagtgaggtccgaacgatcgtcattaactacgccaagaaaaatgacctggttgatgcagacaacaaaaatcttgtgagattggatcccatcctatgtgactgcatcttagagaaaaatgaacagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaaggtgaccgtggtccggaacttggaggcctatggtctggacccatactcagtggctgccatccttcagcagcgatgccaggctagcaccaccgtcaatcctgcccctggggccaaggacagccttcaggtgcagatccagggaaaccaggtccaccacctcggctggctattgcttgaagagtatcagctccctcgaaaacacatccaaggtctagaaaaggccctcaaacctggcaagaagaagtgacagactcttttgtctcacgtggtggatccggtggaaatccaagctctgggctggtaatttttatgagcattttcagcttttgcaaatacaaaatataattctttacaaaaataaatttttattctaatct

SEQ ID NO: 10039 - DNA, 1633 bp, Homo sapiens
cgcggccgggccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagtgtacacgctgtggtcctatcctgatcttctgccaacctttacaacatggcctctggtgctcgagaaactggtagggggagcagatttgatgctgcctggactggtgatgccccctgctggtctgcctcaggtacagaagggcgacctctgtgccatttctttggtggggaacagagcccctgtagccattggagttgcagccatgtccacagctgagatgctcacgtcaggcctgaagggaaggggcttctctgtgctccacacttaccaggaccacttgtgccctgaaggacgacaactggacataaagaagtcaagctacaaaaagctctctaagttcctgcagcaaatgcagcaggagcagattatacaggtgaaggagctgagcaaaggggtggagagcattgtggctgtggactggaaacacccgaggattacatctttcgtcatacccgagccctccccgacctcccagactatccaggagggtagcagggaacagccctatcaccctccagatataaaacccctctactgtgtcccagccagcatgaccctgctcttccaggagtctggccacaagaaggggagctttctggagggcagtgaggtccgaacgatcgtcattaactacgccaagaaaaatgacctggttgatgcagacaacaaaaatcttgtgagattggatcccatcctatgtgactgcatcttagagaaaaatgaacagcatacagtcatgaagcttccatgggacagtcttctgaccaggtgtttggaaaaattacagcctgcctatcaagtgacccttcccggacaagagcccattgtgaagaaagggagaatctgtccaattgacatcaccctagcacaaagagcgtctaataaaaaggtgaccgtggtccggaacttggaggcctatggtctggacccatactcagtggctgccatccttcagcagcgatgccaggctagcaccaccgtcaatcctgcccctggggccaaggacagccttcaggtgcagatccagggaaaccaggtccaccacctcggctggctattgcttgaagagtatcagctccctcgaaaacacatccaaggtctagaaaaggccctcaaacctggcaagaagaagtgacagactcttttgtctcacgtggtggatccggtggaaatccaagctctgggctggtaatttttatgagcattttcagcttttgcaaatacaaaatataattctttacaaaaataaatttttattctaatctaaa

SEQ ID NO: 10040 - DNA, 920 bp, Homo sapiens
gccccagcatggctgcccccacggctgagggcctggcagctgctgcgccctcgctttcttgacattccctggcttctgtgctctcttccccaggccaccccagcagacatgtttgccaaggcctttcgggtcaagtccaacacggccatcaaggggtcggacaggagaaagcttcgagctgatgtgacaactgctttccccacccttggaactgatcaagtctctgagttagtacctggaaaggaggagctcaacattgtgaagttgtatgctcacaaaggggatgcagtgactgtgtacgtgagtggtggtaaccccatcctctttgaactggagaaaaatctgtatccaacagatttgatgctgcctggactggtgatgccccctgctggtctgcctcaggtacagaagggcgacctctgtgccatttctttggtggggaacagagcccctgtagccattggagttgcagccatgtccacagctgagatgctcacgtcaggcctgaagggaaggggcttctctgtgctccacacttaccaggaccacttgtggcggtctggaaacaagtcctctccaccttccattgctccactggccctggattcagcagatctcagtgaagagaaggggtctgtccagatggactccaccctgcagggagacatgaggcacatgaccctggagggggaagaggagaatggggaggttcaccaggcacgtgaagacaagtctctctcagaagccccagaagacaccagcaccaggggcctgaaccaagactccacagatagcaaaacgcttcaagaacaaatggatgagctgttacagcaatgcttcttacatgccttgaagtgccgagtcaaaaaggctgacctccctttactcaccagcactttccttggcagccacatgttctc

SEQ ID NO: 10041 - DNA, 3128 bp, Homo sapiens
gtggcaggcagccctgcaccggacacacagtggcattcaacttcctgcctgccagccccagtgtgtggttcccagcctgacaaccttggcaccccagcaccccagcaggaggggtttctgcttgtggtcccctggccaccagcctcggccagctggttgtggaccagccgtgacctggggcaacccagccaacctcaccgtccaatgggctgcagccacctctctccagtgaggtctgagacccagccttaacgaggctacccccttccaggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgt

SEQ ID NO: 10042 - DNA, 5472 bp, Homo sapiens
ggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacgaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagatgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagcgagtcacaaaggttctaaattgggttagggaacaacctgaaaaggaaccggaattgcagcagtatgtgccacaactgcaaaacaacaccatcctccgccttctgcagcaggtgtcacagatttatcagagcattgagttttctcgtttgacttctttggttccttttgttgatgctttccaactggaacgggccatagtagatgcagccaggcattgcgacttgcaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactgcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgacccttcaggtattgagtaacacctttatcttggtatagaactgatactttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaatttgttttagtgttgatttgtggttatagtattttgtttataatggtaagtttgcatattcagttgagttttttttacttgaatttttatcagtgccattaaatgtctgtgtttagtatcaatgaaaatgaacctaaatataacaaagaaagcatatgtggctaggatgtccccctaacatgtcttcctttgttaatgcag

SEQ ID NO: 10043 - DNA, 4486 bp, Homo sapiens
agaccgatgcggcctgcccgccgctgtcccagccggtggttgggcatgggtttccttctcactctatcgactggggtctgggaggcgcgtagcccggaaccgtcgccccaggggcctttccttccccctgccgcctccggaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtgaacataaaatctctggaggatgttgttagggcatatttgaaaatggcagaggaaaaaactgaagctgctaaagaagaatctcagcagatggtcttagatatagaggatctagataatattcaaactcctgagagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagatgagatgcaaagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggtcagatttaatgtactacaatatgttgtcccagaagtgaaagacctttacaattggcttgaagtagaatttaacccattaaaactctgtgagcgagtcacaaaggttctaaattgggttagggaacaacctgaaaaggaaccggaattgcagcagtatgtgccacaactgcaaaacaacaccatcctccgccttctgcagcaggtgtcacagatttatcagagcattgagttttctcgtttgacttctttggttccttttgttgatgctttccaactggaacgggccatagtagatgcagccaggcattgcgacttgcaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactgcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagaccttgaggaattggatccagattttatcatggctaaacaggttgaacaactggagaaagaaaagaaagaacttcaagaacgcctaaagaatcaagaaaagaagattgactattttgaaagagccaaacgtttggaagaaattcctttgataaagagcgcttacgaggaacagagaattaaagacatggatctgtgggagcaacaagaggaagaaagaattactacaatgcagctagaacgtgaaaaggctcttgaacataagaatcgaatgtcacgaatgcttgaagacagagatttattcgtaatgcgactcaaagctgcacggcagtctgtttatgaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttg

SEQ ID NO: 10044 - DNA, 3000 bp, Homo sapiens
tagccgtcgcggcgcgcggtgcggcctgggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagtccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccggaatcaggagtgacctggagcactgtgcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatg

SEQ ID NO: 10045 - DNA, 3055 bp, Homo sapiens
gggagagtcggaagcgcggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagtccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaa

SEQ ID NO: 10046 - DNA, 2966 bp, Homo sapiens
cggcggccgcggagccctgcgagtaggcagcgttgggcccatgcaggacgcggagaacgtggcggtgcccgaggcggccgaggagcgcgccgagcccggccagcagcagccggccgccgagccgccgccagccgaggggctgctgcggcccgcggggcccggcgctccggaggccgcggggaccgaggcctccagtgaggaggtggggatcgcggaggccgggccggagtccgaggtgaggaccgagccggcggccgaggcagaggcggcctccggcccgtccgagtcgccctcgccgccggccgccgaggagctgcccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtgcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaa

SEQ ID NO: 10047 - DNA, 2693 bp, Homo sapiens
atgcaggacgcggagaacgtggcggtgcccgaggcggccgaggagcgcgccgggtcgcatgctgagccccctgtcccggcacagggcgaggccccaggagagcaggctcgggacgagcgctccgacagccgggcccaggcggtgtccgaggacgcgggaggaaacgagggcagagcggccgaggccgaaccccgggcgctggagaacggcgacgcggacgagccctccttcagcgaccccgaggacttcgtggacgacgtgagcgaggaagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtatattttcctggagtacgcgtcccctgcccacgctgtggatgctgtgaagaacgccgacggctacaagcttgacaagcagcacacattccgggtcaacctctttacggattttgacaagtatatgacgatcagtgacgagtgggatattccagagaaacagcctttcaaagacctggggaacttacgttactggcttgaagaggcagaatgcagagatcagtacagtgtgatttttgagagtggagaccgcacttccatattctggaatgacgtaaaagaccctgtctcaattgaagaaagagcgagatggacagagacgtatgtgcgttggtctcctaagggcacctacctggctacctttcatcaaagaggcattgctctatgggggggagagaaattcaagcaaattcagagattcagccaccaaggggttcagcttattgacttctcaccttgtgaaaggtacctggtgacctttagccccctgatggacacgcaggatgaccctcaggccataatcatctgggacatccttacggggcacaagaagaggggttttcactgtgagagctcagcccattggcctatttttaagtggagccatgatggcaaattctttgccagaatgaccctggatacgcttagcatctatgaaactccttctatgggtcttttggacaagaagagtttgaagatctctgggataaaagacttttcttggtctcctggtggtaacataatcgccttctgggtgcctgaagacaaagatattccagccagggtaaccctgatgcagctccctaccaggcaagagatccgagtgaggaacctgttcaatgtggtggactgcaagctccattggcagaagaacggagactacttgtgtgtgaaagtagataggactccgaaaggcacccagggtgttgtcacaaattttgaaattttccgaatgagggagaaacaggtacctgtggatgtggtcgagatgaaagaaaccatcatagcctttgcctgggaaccaaatggaagtaagtttgctgtgctgcacggagaggctccgcggatatctgtgtctttctaccacgtcaaaaacaacgggaagattgaactcatcaagatgttcgacaagcagcaggcgaacaccatcttctggagcccccaaggacagttcgtggtgttggcgggcctgaggagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtggacaacgcgtactggctgtggactttccagggacgcctcctgcagaagaacaacaaggaccgcttctgccagctgctgtggcggccccggcctcccacactcctgagccaggaacagatcaagcaaattaaaaaggatctgaagaaatactctaagatctttgaacagaaggatcgtttgagtcagtccaaagcctcaaaggaattggtggagagaaggcgcaccatgatggaagatttccggaagtaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggaatcaggagtgacctggagcactgtgcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatg

SEQ ID NO: 10048 - DNA, 3045 bp, Homo sapiens
tctctctcggcgtttccgctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatatttctgagctgctaccacatgacagacacaaggctcagatgaagaggtgaattgaacacgttcctgacctcaaa

SEQ ID NO: 10049 - DNA, 2393 bp, Homo sapiens
tctctcggcgtttccgctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcct

SEQ ID NO: 10050 - DNA, 3093 bp, Homo sapiens
cttctctctcggcgtttccgctgtcagggccctgcggtgtgactcgcgggctcagctggttggtattttttgggcctcgtgcttcgtggtgggagacccaggtcgaggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatgaacaagaacaatgccaaggctctgagcaccttgcgtcagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagttgttctggttgattgcttgttgccacaaaggtgtgttgagcccattcatttgctgattatatttctgagctgctaccacatgacagacacaaggctcagatgaagaggtgaattgaacacgttcctgacctc

SEQ ID NO: 10051 - DNA, 2366 bp, Homo sapiens
gtttccgctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagtt

SEQ ID NO: 10052 - DNA, 2865 bp, Homo sapiens
ctctctcggcgtttccgctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagctttgggaagataaggaagggaagaagaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggatgaggaggaggaggacaatgaaggcggggagtgggaaagggtccggggcggagtgccgttggttaaggagaagccaaaaatgtttgccaagggaactgagatcacccatgctgttgttatcaagaaactgaatgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcactaccgaggaggtctgccgcatctacctgctgcgcatcctgcacacctactacaagtttgattacaaggcccatcagcgacagctgaccccgcctgagggctcctcaaagtctgagcaagaccaggcagaaaatgagggcgaggactcggctgtgttgatggagagactgtgcaagtacatctacgccaaggaccgcacagaccggatccgcacatgtgccatcctctgccacatctaccaccatgctctgcactcgcgctggtaccaggcccgcgacctcatgctcatgagccacttgcaggacaacattcagcatgcagacccgccagtgcagatcctttacaaccgcaccatggtgcagctgggcatctgtgccttccgccaaggcctgaccaaggacgcacacaacgccctgctggacatccagtcgagtggccgagccaaggagcttctgggccagggcctgctgctgcgcagcctgcaggagcgcaaccaggagcaggagaaggtggagcggcgccgtcaggtccccttccacctgcacatcaacctggagctgctggagtgtgtctacctggtgtctgccatgctcctggagatcccctacatggccgcccatgagagcgatgcccgccgacgcatgatcagcaagcagttccaccaccagctgcgcgtgggcgagcgacagcccctgctgggtccccctgagtccatgcgggaacatgtggtcgctgcctccaaggccatgaagatgggtgactggaagacctgtcacagttttatcatcaatgagaagatgaatgggaaagtgtgggaccttttccccgaggctgacaaagtccgcaccatgctggttaggaagatccaggaagagtcactgaggacctacctcttcacctacagcagtgtctatgactccatcagcatggagacgctgtcagacatgtttgagctggatctgcccactgtgcactccatcatcagcaaaatgatcattaatgaggagctgatggcctccctggaccagccaacacagacagtggtgatgcaccgcactgagcccactgcccagcagaacctggctctgcagctggccgagaagctgggcagcctggtggagaacaacgaacgggtgtttgaccacaagcagggcacctacgggggctacttccgagaccagaaggacggctaccgcaaaaacgagggctacatgcgccgcggtggctaccgccagcagcagtctcagacggcctactgagctctccactctgtttcccgcctgggccatccaaccttgaagtcctaaaccacacctcagtcactaaaggtctgtttaaagtt

SEQ ID NO: 10053 - DNA, 2155 bp, Homo sapiens
gagcttcgattgcgcggccgccaagtttcagtgatgaacgccctctttgggcgtccccggataccgcctgacgtagtgccaatcacacctctcgcgtctcggcgcctcggaggctaatgaggacgcctggcgaaacgcagtaacggatttccgggtggaccttcgctttacggctcgtgagttcttccgcccaacccagaggaagcgggagagcagtttacgacagcgccggtcgtgtttacggcggcgcccgctgcgcgcgcatgtttcctcttttcctggtttctcaagagtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctttccctca

SEQ ID NO: 10054 - DNA, 1814 bp, Homo sapiens
agtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctttc

SEQ ID NO: 10055 - DNA, 581 bp, Homo sapiens
aggaatccactttcgggggccccgcgtcccgcacgctactgaacgcgggacacgaccttgtgggtgaggtccttggccctcggccctgctcagtgcccatgagctgggtgaatttgattgtcacttaactcacctgggttaagacggaggggtaacaacaaagtctttctgaagtggccgaaaactccctgactttttgaattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaa

SEQ ID NO: 10056 - DNA, 1851 bp, Homo sapiens
cgggacacgaccttgtgggtgaggtccttggccctcggccctgctcagtgcccatgagctgggtgaatttgattgtcacttaactcacctgggttaagacggagggattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctct

SEQ ID NO: 10057 - DNA, 710 bp, Homo sapiens
caggcagcgagctcagagccccatcaagggccccaggaacctggccagggctgcaactaagcagaggtgctgggtctgactgattggccttggccttgtcaacaaagttagctctgtcttgtgacacctttgtttttgcaggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtcta

SEQ ID NO: 10058 - DNA, 678 bp, Homo sapiens
gctgcgcgcgcatgtttcctcttttcctggtttctcaagagtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacaggtaatgtatttataccagaattctgccttggaatttggttctgtttatttggttgtctttattaatagcttagatgagatatacttcacatacc

SEQ ID NO: 10059 - DNA, 996 bp, Homo sapiens
ctcttttcctggtttctcaagagtgctgctgctaacgcggtccccggcacgcaccatctgttgccatcccggccggccgaggccattgcagatggaaaagactaaggtggctggacgtggtggctcacgcctgtaatcccagcactttgggaggtcgaggcgggaggatcatttgagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtcca

SEQ ID NO: 10060 - DNA, 729 bp, Homo sapiens
aggtgagcggcgtgtttcataggttcctgcggccctccggagccggttcggactaggtccagccttcggggggcctcccggaagagacctctcttagtcccttcctgctgttgccgtccctccgctgggcggggcaggaatccactttcgggggccccgcgtcccgcacgctactgaacgcgggacacgaccttgtggattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggtacacaaataagtactcctctcagtttggtggtggaagtcaatatgcttatttccatgaggaggatgaaagtagcttccagctggtggatacagcgcgcacacagaagacggcctaccagcggaatcgaatgagatttgcccagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaat

SEQ ID NO: 10061 - DNA, 883 bp, Homo sapiens
ctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgcgctgcgcacattgtcagtgactctttgttgcatggtgagtgaccatgccacgcttttgcagacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagcc

SEQ ID NO: 10062 - DNA, 1731 bp, Homo sapiens
ctcttttcctggtttctcaagagtgctgctgctaacgcggtccccggcacgcaccatctgttgccatcccggccggccgaggccattgcagattttggaagatggcaaagttcatgacacccgtgatccaggacaacccctcaggctggggtccctgtgcggttcccgagcagtttcgggatatgccctaccagccgttcagcaaaggagatcggctaggaaaggttgcagactggacaggagccacataccaagataagaggaacctccgcagagacaaagatcgtcggaacatgttgcagttcaacctgcagatcctgcctaagagtgccaaacagaaagagagagaacgcattcgactgcagaaaaagttccagaaacaatttggggttaggcagaaatgggatcagaaatcacagaaaccccgagactcttcagttgaagttcgtagtgattgggaagtgaaagaggaaatggattttcctcagttgatgaagatgcgctacttggaagtatcagagccacaggacattgagtgttgtggggccctagaatactacgacaaagcctttgaccgcatcaccacgaggagtgagaagccactgcggagcatcaagcgcatcttccacactgtcaccaccacagacgaccctgtcatccgcaagctggcaaaaactcaggggaatgtgtttgccactgatgccatcctggccacgctgatgagctgtacccgctcagtgtattcctgggatattgtcgtccagagagttgggtccaaactcttctttgacaagagagacaactctgactttgacctcctgacagtgagtgagactgccaatgagccccctcaagatgaaggtaattccttcaattcaccccgcaacctggccatggaggcaacctacatcaaccacaatttctcccagcagtgcttgagaatggggaaggaaagatacaacttccccaacccaaacccgtttgtggaggacgacatggataagaatgaaatcgcctctgttgcgtaccgttaccgcaggtggaagcttggagatgatattgaccttattgtccgttgtgagcacgatggcgtcatgactggagccaacggggaagtgtccttcatcaacatcaagacactcaatgagtgggattccaggcactgtaatggcgttgactggcgtcagaagctggactctcagcgaggggctgtcattgccacggagctgaagaacaacagctacaagttggcccggtggacctgctgtgctttgctggctggatctgagtacctcaagcttggttatgtgtctcggtaccacgtgaaagactcctcacgccacgtcatcctaggcacccagcagttcaagcctaatgagtttgccagccagatcaacctgagcgtggagaatgcctggggcattttacgctgcgtcattgacatctgcatgaagctggaggagggcaaatacctcatcctcaaggaccccaacaagcaggtcatccgtgtctacagcctccctgatggcaccttcagctctgatgaagatgaggaggaagaggaggaggaagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctt

SEQ ID NO: 10063 - DNA, 1543 bp, Homo sapiens
tgttcgtttgtcggcgctaccaataaagttttagtgagcacagactcccttttctttggcaagatggcggagtacgacttgactactcgcatcgcgcactttttggatcggcatctagtctttccgcttcttgaatttctctctgtaaaggagatatataatgaaaaggaattattacaaggtaaattggaccttcttagtgataccaacatggtagactttgctatggatgtatacaaaaacctttattctgatgatattcctcatgctttgagagagaaaagaaccacagtggttgcacaactgaaacagcttcaggcagaaacagaaccaattgtgaagatgtttgaagatccagaaactacaaggcaaatgcagtcaaccagggatggtaggatgctctttgactacctggcggacaagcatggttttaggcaggaatatttagatacactctacagatatgcaaaattccagtacgaatgtgggaattactcaggagcagcagaatatctttatttttttagagtgctggttccagcaacagatagaaatgctttaagttcactctggggaaagctggcctctgaaatcttaatgcagaattgggatgcagccatggaagaccttacacggttaaaagagaccatagataataattctgtgagttctccacttcagtctcttcagcagagaacatggctcattcactggtctctgtttgttttcttcaatcaccccaaaggtcgcgataatattattgacctcttcctttatcagccacaatatcttaatgcaattcagacaatgtgtccacacattcttcgctatttgactacagcagtcataacaaacaaggatgttcgaaaacgtcggcaggttctaaaagatctagttaaagttattcaacaggagtcttacacatataaagacccaattacagaatttgttgaatgtttatatgttaactttgactttgatggggctcagaaaaagctgagggaatgtgaatcagtgcttgtgaatgacttcttcttggtggcttgtcttgaggatttcattgaaaatgcccgtctcttcatatttgagactttctgtcgcatccaccagtgtatcagcattaacatgttggcagataaattgaacatgactccagaagaagctgaaaggtggattgtaaatttgattagaaatgcaagactggatgccaagattgattctaaattaggtcatgtggttatgggtaacaatgcagtctcaccctatcagcaagtgattgaaaagaccaaaagcctttcctttagaagccagatgttggccatgaatattgagaagaaacttaatcagaatagcaggtcagaggctcctaactgggcaactcaagattctggcttctactgaagaaccataaagaaaagatgaaaaaaaaaactatcaaagaaagatgaaataataaaactattatataaagggtgacttacattttggaaacaacatattacgtataaattttgaagaattggaataaaattgattcatttta

SEQ ID NO: 10064 - DNA, 1254 bp, Homo sapiens
atttccgcttccgcctccttctttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgatccacgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaatt

SEQ ID NO: 10065 - DNA, 1068 bp, Homo sapiens
tttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggtggctgttgacatggaatttgctaagaatatgtatgaactgcataaaaaagtttctccaaatgagctcatcctgggctggtacgctacgggccatgacatcacagagcactctgtgctgatccacgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcaga

SEQ ID NO: 10066 - DNA, 7540 bp, Homo sapiens
aaatcgcttctgggtgcagccacaggagtggggttgttggtccaggtggagccatggttgagggaaaaactaaaacatgacagagtttattcatcaatgggaacttttatatactgttagaaggcatgtaaattggaacagcctctttggaaaacaagtctgcattatcttcctcgagcttctgggctcaaacgatccttccgcctcggtctcccgaagtgctgagattacaggcgtgagccaccgcgcctggccttaaaatcctttttaaaggcactttgacatccattatctcatttaagtctaaaacacgaatttcgacctccgcgctgctttctggttccacctggcggcagctgcacaaagtgtttctcttcgaacgccgtcccaagttttacccggaactacttagcccagggtttcctgagtgctcctcgggccaaaagcagagcgcacaaattccagaagaaattaccaacggcgggactatttcagtgctccgagaagtatcaccagtaaccaatcagcaaaaagctctagctcacgtggtgtatattcagcctatcaagctcctgatattcatgaatgctgtcatttccgcttccgcctccttctttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgatccacgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaattaatttcatcttatgtgagtttattgccgggtggaagggaggaaaatgttttagatcacacagaaactaggaagtgaatattgtaggtagagaagttggttatgtgtttggcatgttactgttttaccaaactgttcttttggttttcaatatggaaaggtgtccattggcaaaacaaccttttcttgaggattcatgtgatttctacaggaaatgaaaataagaatccatggagaaaaaatagctaagaaaattggatgcttaatctgaactaaaagagtagagtgtgtagtcactatcttaaaatacattaatagtaagatggagctctttgccactttggttcggggaggcagaattaagatctgtgggttaaagattaaagaggtttccccaaaacttcagaaaattcttaggtgctatctgtaactcgaggatagagccttgagttatactgaggtctgccagtggctcaatttaagcaaagactagatggcatttcccagaggccttgtaggctagagtacttgcctgtgtaacttcagacatccatttcctctggtatcctggagttccgcctcgccactgtgtgtcttagaaataagtcattattcaagaactcaggaaattatacgttggagtgaaaaggtgagtgaaggcaatggggaatcaaaaaggcctggatcctagttctgaggtatgtgtagccttaggaaagataaattataagagtcataagatatggatcataaacatacatagtccattagggtattatgaggattccatgaattaataaatgtcaggttaatcaacacttgtggagaatatcacctggtatgtagtaagcacagataagtggtagatactatgatgcctaaaggtgaatagtttgaaagtaataagcaacatgaaccccagcctggaactcagttctgagatatgtacctcaggaaatataagttatgggagtcataaagtgtggatagtaatgatagataatttcttacaggtagggaaatgtaaacagatcttatcggcaaaatgataatgacaggccaaattgttaaaggtaggttaaaagtagacagcatggtgggaaggttaatcagagtcaaaatgtttcagtgttcttacatttttgggagtagccagttaatatcaacttagtctttttaagtatgcatgataaaattccgaggttaattgctagaagtatatataatctctcaatgaatagtgatgagagatggtgggataatagggaagaaacaaaattttaaatttgagaaataagcatagaaaaggtggataaaacaaaagatggcaaaacaagtccaaatagatcagtaattacaataaatgtataagtattaaactagcccaaggaaaaattgaatattaaaacaaaccccaatcatatgctgtttacaggagacacatctaaaacaaggacataaagttgtcctgcagctgtgagtaacaatataggtgaatgttaataataatgttgaatgaaaaaagctggtgtcagaagacatgtacattatgatactccagaagttcaaaaacaagtgaaacttgtttagacatgcggttggctgtctgtatatgtgggttccacatctatggactcaaccaactacaggttgaaaatattgagggggaaaattgtgtctggactaaacctgtacagacatttttccttgtcatttttccctaaacaatacaaagtattagatggtgtttatactgtattcggtattataagtaatctagagatgacttaaaagtatatgagaaggtatgcacaggttatatccaaatacttcatattagggacttgagcatcagaggatttttatatccaaggaaggttctggaaccaatcctccacggatactaaacggtgactgtgtgtgtatatatatatgtatagtctgttctcattatctatagtagttatgttttataaagtcaccatgaacactgaattagagagtactgaaccattattcccaagggaaatacagggttgggttcctatgaacctctgggcacagtttcatcaacccatcagtacataaacttgttacatgtgtttctgtttgaagacaccttagtatatatggttgacccattaacactgaacttagcccacgacacttattcctgaatgaagcttacctcagtttctccaggcggcacatcacagtcttcttgcacttaggaacacttggcactgtgcgtgggggtcactttaagcagcaaaatccacaaaaatgcaaaagacatggcactaaatagactgaaaaggatacttgtttataagaactgaaacaagaaggccttgttccacctcagctgggaacatggagagcaggcaattcaaattttttcacatgctgcatgtccgcaaatggctgcaaaagcccagcaagtactgatactggagttagaaataaattttagcaagaggtaaattcacacatacggagtctgcaaaaaatgagaattgactattatgtgtgtgtatattatatatatgataaaaaacaaaagaatgataaaaattcccaataatgtttactttggtggtgagaagaggatggcaagtaaaataagtctgtattgttatcagcaattatctagtttgaggttggacagtggtttcatcataggtattgattatattataaatagcccaacctgaactcatgaccatagtgtggtgttattacttagcgttattctagacttattagccattgtatttaaacaagaggaaatagagacattgaagataaagtggagccaggcacagtggctcatgcctgtaatcccagcactttggcaggctgagatgggttaatcaagaccagaagttcaagaccagcgtggccaacatggcaaaaccccgtctctactaaaaaaaaacaaaaaatacaaaaattagccaggcgtggtggcacgcacctgtagtcccagctacttgggaagctgaggcaggagaatctcgaacccaggaggtaggggttgcagtgagctgagatcgcaccactgcaccccagcctgggtgacagcaagatcctttctcaagaaaaaaagtgaaaaggaggagggtttttaaaaaattagtactacccagttgatacggtggaagaaaacttgaaaatgctaatgagaaacatgagatgtaatcacttgaaggcatatcatgttcttgaataagaagactcaacattattttaacaggtgttaattttccctgttaaactacatatttgtcataattacaataaaatacaaagagctattttggaactgggcaagctgtttctaaatgtatatggaaaaataaaaatgtctccaaaaaatccctgcagagggaaactagcccttccagatataaaatatattatagaactgtgtaattaaagcaatatggtactggtccataaaagaacataaaaccaaatagttcagtagactcaaaatgcaagcgttggtgagggtatggagaaaagggaacccttttacacttggtgtgaatgtaaattagtacagacattgtggaaaacagtttgtagagcttcctcaataaaaacacatatgatccagcaatcccactactgggtatatatccaaaggaaatgaaatcagtatgttgaagagatacttccacgttcactgaagcattgttcacaatcgccaagacatcaacctaagtgtccatcaacagaagatagatagggctgagcgcggtggcccacgcctgtaatcccagcactttgggaggccaaggcaggtggatcatttgaggtcagaagttcttgaccagcctggccaacatgatgaaaccccgtctctacaaaagatacaaaaattagccaggcatcttggagggcgcctgtaatcccacctactcgggctgaagtgagaatggcttgaacccaggaagtggagatttcagtgagctgagattccgccactgcagtccagcctgagcgacaagagtgagaagagtgagacttcatctcaaaaaaaaaaaaggtacatctacacaatggaatattattaaccttaaaagaaggaaataactgatttacaacaacatggatggacctggaggacactatgctagtgaaataagccatgatctcacttggatatggaatcacaaaattgaactcacaagcagagtgtagaaaggtggtttcatggactggagggaggggataaatggggagatgttggtcaagggtacaaagtttcagttaaacaggagtagtacgttccggagacctgttgtgcagcagggtgactagttaatgtatacttgaaaattgctaggagtagatctcaccaggagaaatgaatatgtgaggtgatggatgtaactagcttgattgtggtaatcaatttcgcaatgtgtacatatatcaaaacatcacattgtacaaaatacatacagtttttgtcaatttaaagatatcagaattctagaatatgataaagttgtgttttcaagcaagtaaagatagattacttaagagcgaatgagtggtaatttggaaacaatgttggattcctacttcgttacctgcaccaaaataagttgctcatggaataaaaacttgtctgaaaaaaaaaccataaatatgagggaaaaaacacagcaatgtgtttttaatgatttatgagtgaggaagaactttctaagaactgagaatccaggagttattttaaaagactgacaaatttagcaacatttttaaaatctgagtgtcaaattacacacatacacaaatagtcaatacaaatataaaactgggaaaatatttgcagttcatatcaaaaaaagggctaatattcttgtcccagaattcctacagttttttaaggccagtaatttgatacattagtgtgtaaaggatatgaccagacagctcacacacagacacacaaatgtgaaaagatgcttgatctcactgataaagcataaattaaaacgatgtcatttttaaaaatcagattcgcaaattttaaaagttgctaacactggaatggccagagtaagaggaaacgtgacacaggcacagattgctggtagacatataagttggtacagccctctctatgtaattttgtgtttgtcaaaattacaaatatgcatgcccttaacccaggaattccactcctcattatatatcctacaaataaactggtctcgttatgacacaatgtaatgaatacatagataagtactgaaatacttggttatcatagcgtaaagatggtaatcaacccaaatgactattaccagaatagaaattaaacaaagtatgatatatccataaaacacaatactatgcagctgttaagcagaatgagacagtcctctatatatcaatatggataaagagtaagtgaaaaaagccaggagagaatgttgtctataatatgctgttgttgtgtacgggaaaataaataatataaatacctagaatatttgtgaaggtacagccaagaaactactatcactgattgtcttaaggtactagatggggcacaggacaggacgaaagatttacttcttattgtttcttctgtataacttttgaattttatgctgttaatgtaatttttcaaaaaaatatataaaaatataaaaacatgaaaaacatgaaacaa

SEQ ID NO: 10067 - DNA, 1684 bp, Homo sapiens
cattgcagcctcgagcttctgggctcaaacgatccttccgcctcggtctcccgaagtgctgagattacaggcgtgagccaccgcgcctggccttaaaatcctttttaaaggcactttgacatccattatctcatttaagtctaaaacacgaatttcgacctccgcgctgctttctggttccacctggcggcagctgcacaaagtgtttctcttcgaacgccgtcccaagttttacccggaactacttagcccagggtttcctgagtgctcctcgggccaaaagcagagcgcacaaattccagaagaaattaccaacggcgggactatttcagtgctccgagaagtatcaccagtaaccaatcagcaaaaagctctagctcacgtggtgtatattcagcctatcaagctcctgatattcatgaatgctgtcatttccgcttccgcctccttctttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgatccacgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaatt

SEQ ID NO: 10068 - DNA, 1472 bp, Homo sapiens
cttctttctcgacaagatggccacaccggcggtaccagtaagtgctcctccggccacgccaaccccagtcccggcggcggccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgatccacgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaattaatttcatcttatgtgagtttattgccgggtggaagggaggaaaatgttttagatcacacagaaactaggaagtgaatattgtaggtagagaagttggttatgtgtttggcatgttactgttttaccaaactgttcttttggttttcaatatggaaaggtgtccattggcaaaacaaccttttcttgaggattcatgtgatttctacaggaaatgaaaataagaatccatggagaaaaaatagctaagaaaattggatgcttaatctgaactaaaagagtagagtgtgtagtcactatcttaaaatacattaatagtaagatggagctctttgccactttggttcggggaggcagaattaagatctgtgggttaaagattaaaga

SEQ ID NO: 10069 - DNA, 1127 bp, Homo sapiens
gtctcgttttcgcccgcttccgctctctggccgggcttgggctgcgtggagaatactttttgcgatgcctactggagactttgattcgaagcccagttgggccgaccaggtggaggaggagggggaggacgacaaatgtgtcaccagcgagctcctcaaggggatccctctggccacaggtgacaccagcccagagccagagctactgccgggagctccactgccgcctcccaaggaggtcatcaacggaaacataaagacagtgacagagtacaagatagatgaggatggcaagaagttcaagattgtccgcaccttcaggattgagacccggaaggcttcaaaggctgtcgcaaggaggaagaactggaagaagttcgggaactcagagtttgacccccccggacccaatgtggccaccaccactgtcagtgacgatgtctctatgacgttcatcaccagcaaagaggacctgaactgccaggaggaggaggaccctatgaacaaactcaagggccagaagatcgtgtcctgccgcatctgcaagggcgaccactggaccacccgctgcccctacaaggatacgctggggcccatgcagaaggagctggccgagcagctgggcctgtctactggcgagaaggagaagctgccgggagagctagagccggtgcaggccacgcagaacaagacagggaagtatgtgccgccgagcctgcgcgacggggccagccgccgcggggagtccatgcagcccaaccgcagagccgacgacaacgccaccatccgtgtcaccaacttgtcagaggacacgcgtgagaccgacctgcaggagctcttccggcctttcggctccatctcccgcatctacctggctaaggacaagaccactggccaatccaagggctttgccttcatcagcttccaccgccgcgaggatgctgcgcgtgccattgccggggtgtccggctttggctacgaccacctcatcctcaacgtcgagtgggccaagccgtccaccaactaagccagctgccactgtgtactcggtccgggacccttggcgacagaagacagcctccgagagcgcgggctccaagggcaataaagcagctccactctctcta
